(12) United States Patent
Bagnoli et al.

(10) Patent No.: US 8,632,783 B2
(45) Date of Patent: Jan. 21, 2014

(54) COMPOSITIONS FOR IMMUNISING AGAINST STAPHYLOCOCCUS AUREUS

(75) Inventors: Fabio Bagnoli, Monteriggioni (IT); Luigi Fiaschi, Sovicille (IT)

(73) Assignee: Novartis AG, Basel (CH)

( * ) Notice: Subject to any disclaimer, the term of this patent is extended or adjusted under 35 U.S.C. 154(b) by 0 days.

(21) Appl. No.: 13/234,077

(22) Filed: Sep. 15, 2011

(65) Prior Publication Data

US 2012/0093850 A1    Apr. 19, 2012

Related U.S. Application Data

(63) Continuation-in-part of application No. PCT/IB2010/000998, filed on Apr. 14, 2010.

(60) Provisional application No. 61/212,705, filed on Apr. 14, 2009, provisional application No. 61/234,079, filed on Aug. 14, 2009.

(51) Int. Cl.
*A61K 39/085* (2006.01)
*C07H 21/04* (2006.01)
*C07K 14/31* (2006.01)

(52) U.S. Cl.
USPC .......... 424/243.1; 424/190.1; 424/197.1; 530/350; 536/23.7

(58) Field of Classification Search
None
See application file for complete search history.

(56) References Cited

U.S. PATENT DOCUMENTS

2004/0191845 A1* 9/2004 Bayley et al. ............... 435/7.33

FOREIGN PATENT DOCUMENTS

| WO | WO-02094868 | 11/2002 |
|---|---|---|
| WO | WO-03020875 | 3/2003 |
| WO | WO-2007145689 | 12/2007 |
| WO | WO-2008019162 | 2/2008 |
| WO | WO-2009029831 | 3/2009 |
| WO | WO-2010081875 | 7/2010 |

OTHER PUBLICATIONS

Kawate et al , 2003 Protein Science 2003, 12:997-1006.*
Kamio et al 2001, *Staphylococcus aureus* Infection and Disease: Edited by Allen Honeyman, Herman Friedman, Mauro Bendinelli. Chapter 10 , pp. 179-211.*
Gouaux et al 1994 (Proc. Natl. Acad. Sci. USA vol. 91, pp. 12828-12831).*
Song et al 1996,Science 274: pp. 1859-1866.*
EBI accession No. ABM72354 (Nov. 20, 2003).
EBI accession No. ABM73069 (Nov. 20, 2003).
Burts et al. (2005). "EsxA and EsxB are secreted by an ESAT-6-like system that is required for the pathogenesis of *Staphylococcus aureus* infections," Proc Natl Acad Sci USA 102(4): 1169-1174.
Schaffer et al. (2008). "Vaccination and passive immunisation against *Staphylococcus aureus*," Int J Antimicrob Agents. vol. 32 Suppl 1:S71-8.
International Search Report mailed Jan. 14, 2011, for PCT Application No. PCT/IB2010/000998 filed Apr. 14, 2010. 8 pages.
Cheley et al. (1997). "Spontaneous oligomerization of a staphylococcal alpha-hemolysin conformationally constrained by removal of residues that form the transmembrane beta-barrel," Protein Eng. 10(12):1433-43.
GI:88194865 (NCBI Reference Sequence: YP_499665.1, alpha-hemolysin [Staphylococcus aureus subsp. aureus NCTC 8325]). Jun 10, 2013. First seen at NCBI on Feb 18, 2006.
GI:151221285 (NCBI Reference Sequence: YP_001332107.1, alpha-hemolysin precursor [Staphylococcus aureus subsp. aureus str. Newman]). Jun 10, 2013. First seen at NCBI on Jul 6, 2007.
Ragle and Wardenburg (2009). "Anti-alpha-hemolysin monoclonal antibodies mediate protection against Staphylococcus aureus pneumonia," Infect Immun (77):2712-8.

* cited by examiner

*Primary Examiner* — Padma V Baskar

(57) ABSTRACT

*Staphylococcus aureus* Hla polypeptides having various deletions, insertions, and/or mutations which are useful for immunization are provided herein. Also provided herein are Hla heptamers which are non-haemolytic. Additionally, an effective *Staphylococcus aureus* vaccine may require several antigenic components, and so various combinations of *S. aureus* antigens, including Hla polypeptides having deletions, insertions, and/or mutations, are identified for use in immunization. These polypeptides may optionally be used in combination with *S. aureus* saccharides.

11 Claims, 26 Drawing Sheets

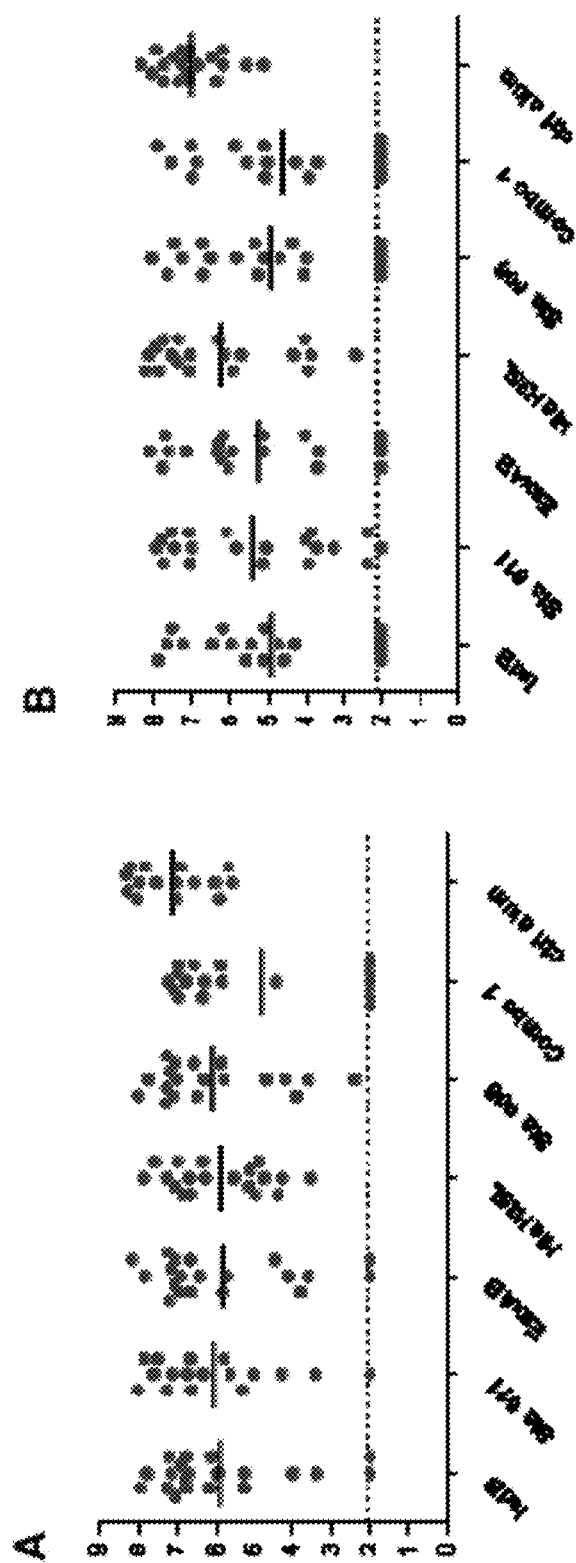
Figure 7 – Part 1 of 2

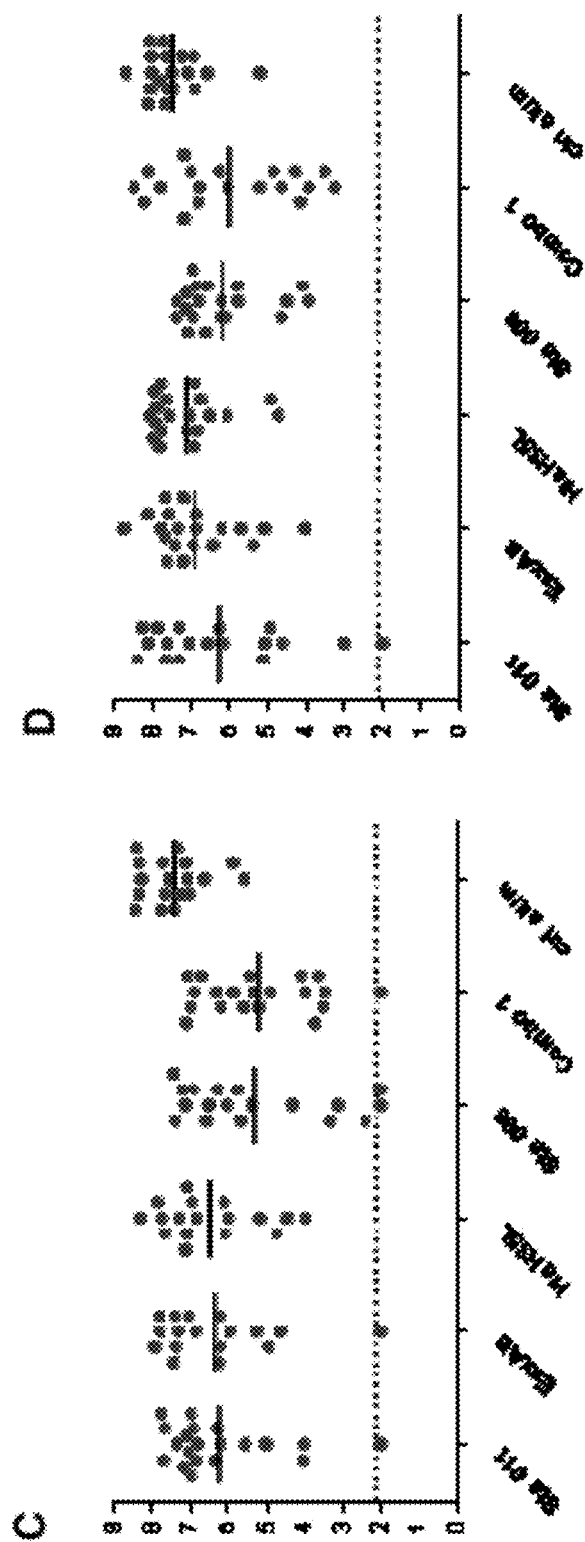
Figure 7 – Part 2 of 2

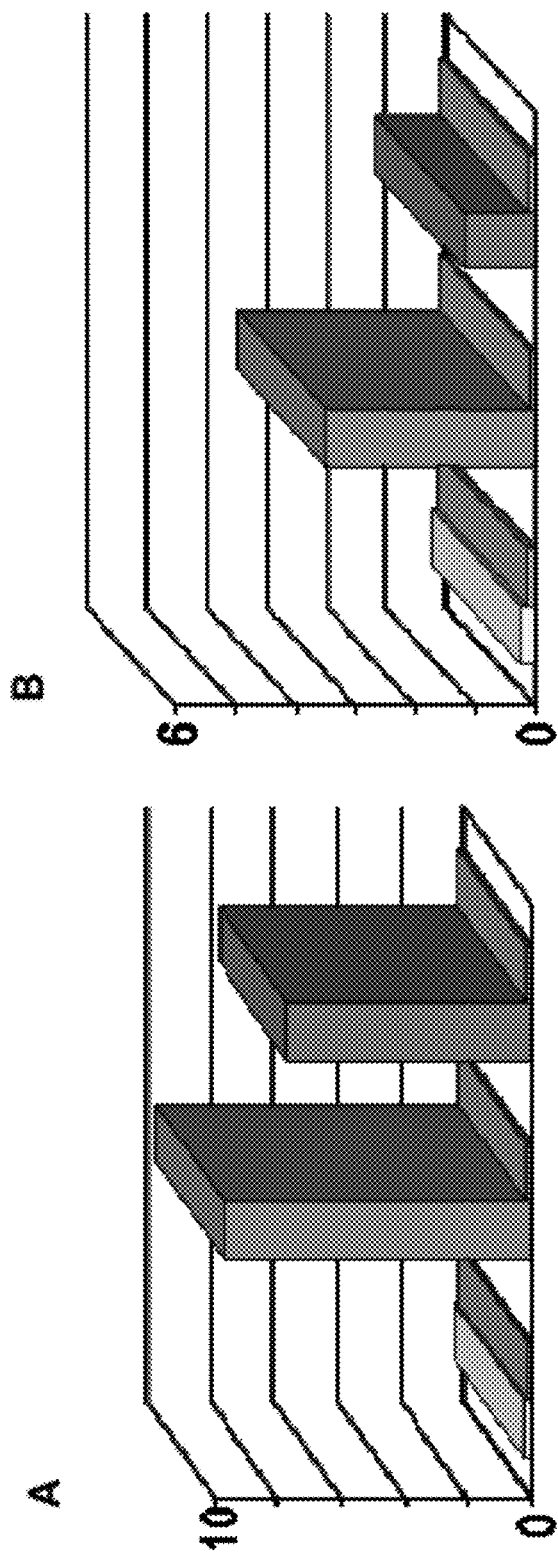
Figure 9 – Part 1 of 2

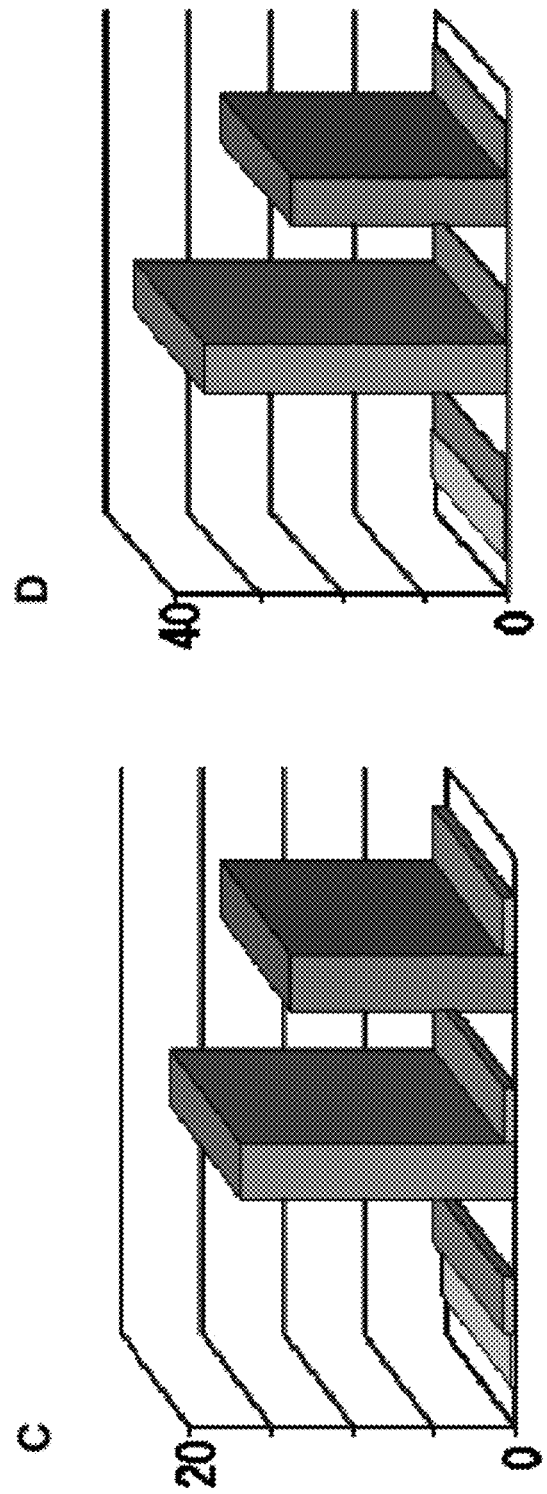
Figure 9 – Part 2 of 2

Figure 18

```
                                    10        20         30
                         ADSDINIKTGTTDIGSNTTVKTGDLVTYDKENGM
                         ||||||||||||||||||||||||||||||||||
HKTRIVSSVTTTLLLGSILMNPVANAADSDINIKTGTTDIGSNTTVKTGDLVTYDKENGM
 10        20        30        40        50        60

40        50        60        70        80        90
HKKVFYSFIDDKNHNKKLLVIRTKGTIAGQYRVYSEEGANKSGLAWPSAFKVQLQLPDNE
||||||||||||||||||||||||||||||||||||||||||||||||||||||||||||
HKKVFYSFIDDKNHNKKLLVIRTKGTIAGQYRVYSEEGANKSGLAWPSAFKVQLQLPDNE
     70        80        90       100       110       120

100       110
VAQISDYYPRNSIDTP-------------SGS-------------------VQPDFK
||||||||||||||||             :|:                   ||||||
VAQISDYYPRNSIDTKEYMSTLTYGFNGNVTGDDTGKIGGLIGANVSIGHTLKYVQPDFK
     130       140       150       160       170       180

120       130       140       150       160       170
   TILESPTDKKVGWKVIFNNMNVMQNWGPYDRDSWNPVYGNQLFMKTRNGSMKAADNFLDPN
   ||||||||||||||||||||||||||||||||||||||||||||||||||||||||||||
   TILESPTDKKVGWKVIFNNMNVMQNWGPYDRDSWNPVYGNQLFMKTRNGSMKAADNFLDPN
     190       200       210       220       230       240

180       190       200       210       220       230
   KASSLLSSGFSPDFATVITMDRKASRQQTNIDVIYERVRDDYQLHWTSTNWKGTNTKDKW
   |||||||||||||||||||||||||||||||||||||||||||||||||||||||||||
   KASSLLSSGFSPDFATVITMDRKASRQQTNIDVIYERVRDDYQLHWTSTNWKGTNTKDKW
     250       260       270       280       290       300

240       250
  IDRSSERYKIDWEKEEMTN
  |||||||||||||||||||
  IDRSSERYKIDWEKEEMTN
       310
```

Figure 19

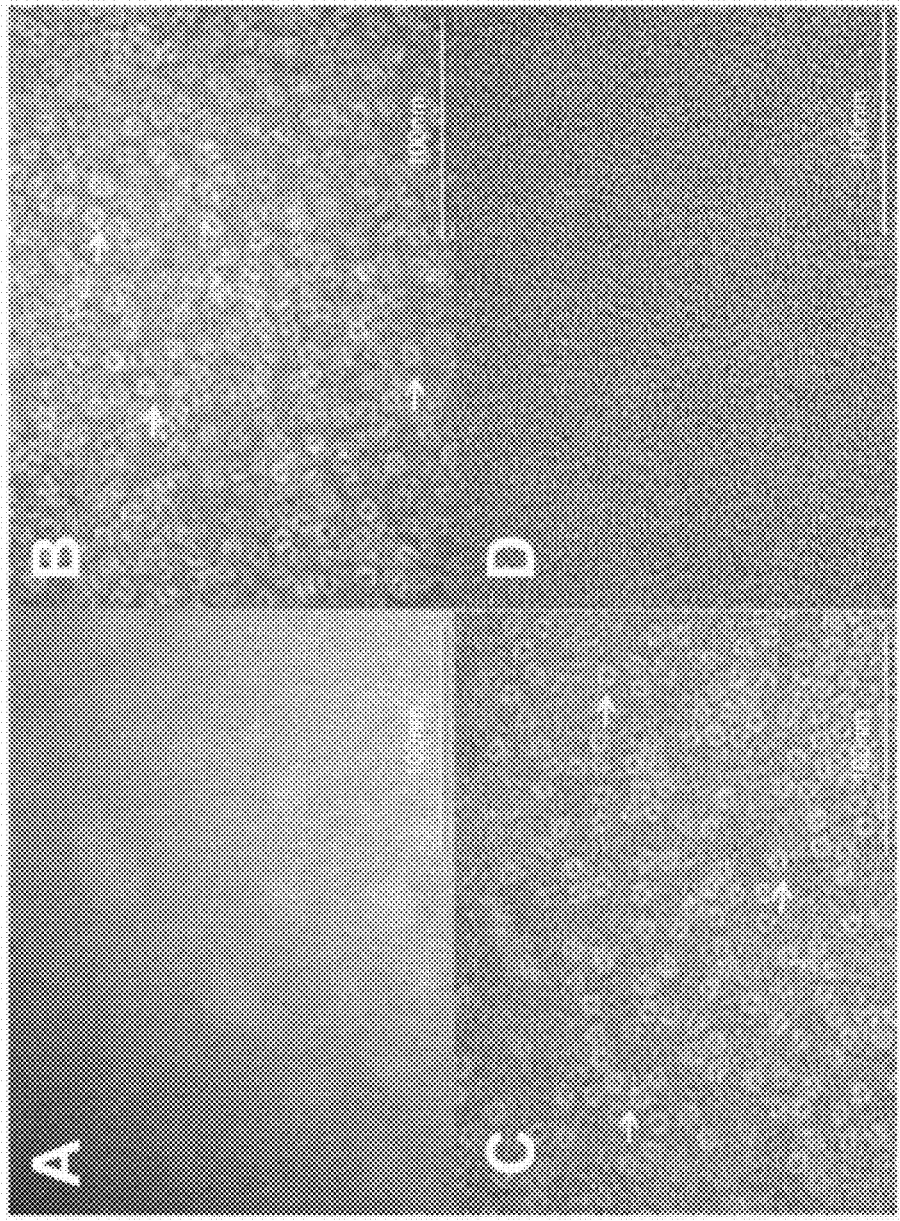
Figure 22 - Part 1 of 2

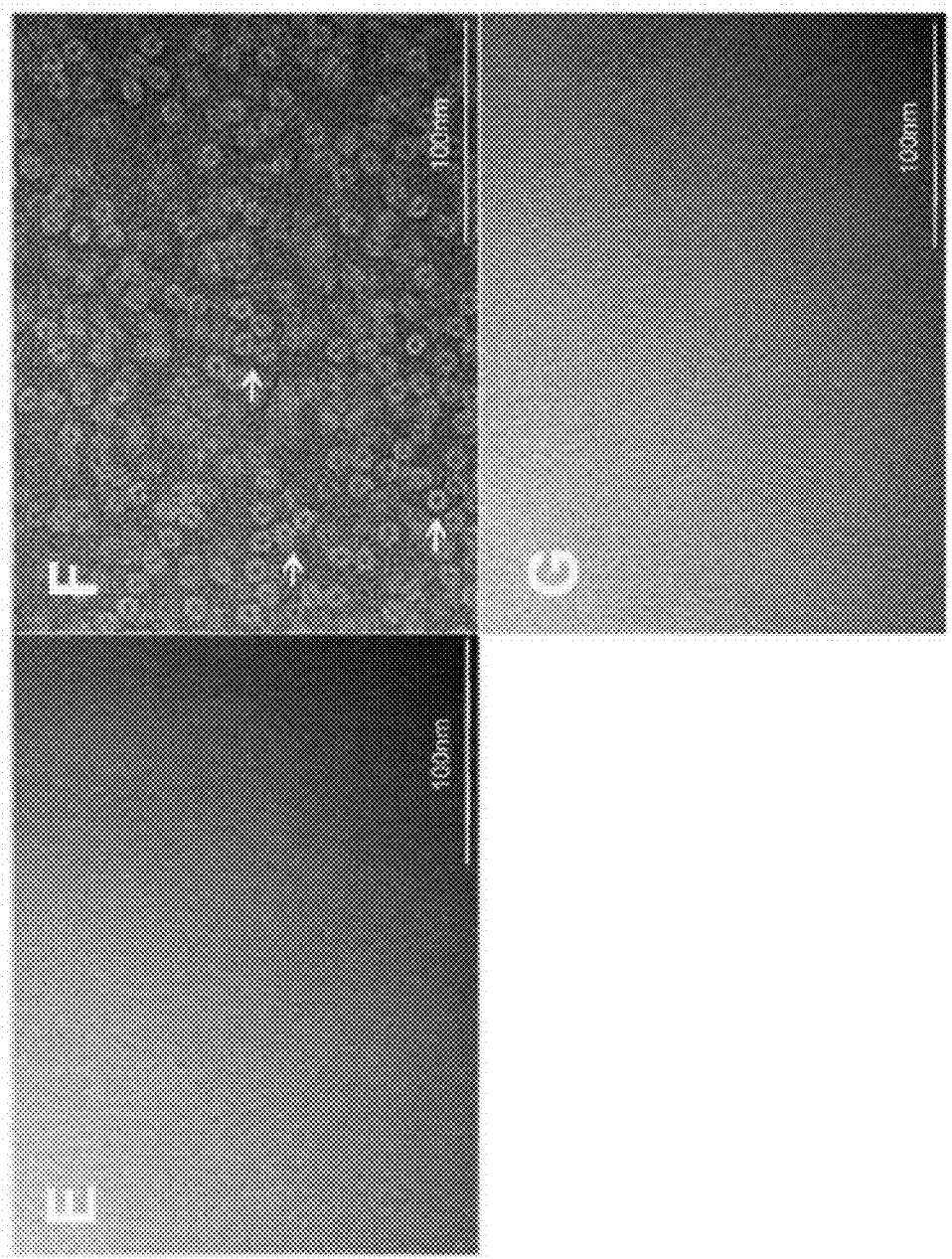
Figure 22 – Part 2 of 2

COMPOSITIONS FOR IMMUNISING AGAINST *STAPHYLOCOCCUS AUREUS*

CROSS REFERENCE TO RELATED APPLICATIONS

This application is a Continuation-in-part of PCT Application No. PCT/IB2010/000998, with a filing date of Apr. 14, 2010, which claims the benefit of U.S. Provisional Patent Application Ser. No. 61/212,705, filed Apr. 14, 2009, and U.S. Provisional Patent Application Ser. No. 61/234,079, filed Aug. 14, 2009, all of which are incorporated herein by reference in their entirety.

TECHNICAL FIELD

This invention relates to antigens derived from *S. aureus* and to their use in immunisation.

BACKGROUND ART

*Staphylococcus aureus* is a Gram-positive spherical bacterium. Annual US mortality exceeds that of any other infectious disease, including HIV/AIDS, and *S. aureus* is the leading cause of bloodstream, lower respiratory tract, skin & soft tissue infections. There is currently no authorised vaccine. A vaccine based on a mixture of surface polysaccharides from bacterial types 5 and 8, StaphVAX™, failed to reduce infections when compared to the placebo group in a phase III clinical trial in 2005.

Reference 1 reports that the "V710" vaccine from Merck and Intercell is undergoing a phase 2/3 trial on patients undergoing cardiothoracic surgery. The V710 vaccine is based on a single antigen, IsdB [2], a conserved iron-sequestering cell-surface protein.

*S. aureus* causes a range of illnesses from minor skin infections to life-threatening diseases such as pneumonia, meningitis, osteomyelitis, bacteremia, endocarditis, toxic shock syndrome, organ abscesses and septicemia. The bacterium has multiple virulence factors which are differentially expressed during different phases of its life cycle, and so a vaccine which can prevent one disease might not prevent another. For instance, the V710 vaccine may be effective against hematic spread of the *S. aureus*, but may be ineffective against pneumonia. One aim of the invention is to provide vaccines which can protect against hematic spread and pneumonia, and which may also elicit an opsonic response.

Thus there remains a need to identify further and improved antigens for use in *S. aureus* vaccines, and in particular for vaccines which are useful against multiple *S. aureus* pathologies.

DISCLOSURE OF THE INVENTION

The inventors have identified various *S. aureus* polypeptides that are useful for immunisation, either alone or in combination. These polypeptides may be combined with *S. aureus* saccharides or other *S. aureus* polypeptides. The antigens are useful in *S. aureus* vaccines but may also be used as components in vaccines for immunising against multiple pathogens.

Hla Polypeptides Lacking a Stem-Like Structure

In one embodiment, the inventors have identified *S. aureus* Hla polypeptides which are useful for immunisation that have a deletion of some or all amino acids of a stem-like structure in the Hla polypeptide. The amino acids of the stem-like structure of an Hla polypeptide correspond to amino acids 136-174 of SEQ ID NO: 14. The stem-like structure of an Hla polypeptide is part of the membrane-spanning pore formed by a heptamer of Hla polypeptides. Deletion of the some or all amino acid of the stem-like structure Hla polypeptides may reduce or eliminate the haemolytic activity of Hla polypeptides, while allowing the modified Hla polypeptides to still form heptamers.

Provided herein is an isolated Hla polypeptide, wherein the Hla polypeptide is part of a non-haemolytic Hla heptamer. Also provided herein is an isolated Hla polypeptide, wherein the Hla polypeptide is part of a non-haemolytic Hla heptamer, and wherein the isolated Hla polypeptide has one or more amino acid deletions from the stem-like structure of the Hla polypeptide.

Hla polypeptides that have a deletion of some or all of the stem-like structure may also have a deletion of some or all of a leader sequence at the N-terminus of the Hla polypeptide. The amino acids of the N-terminal leader sequence of an Hla polypeptide correspond to amino acids 1-26 of SEQ ID NO: 14.

The disclosure provides isolated Hla polypeptides which lack at least 5, 10, 15, 20, 25, 30, 31, 32, 33, 34, 35, 36, 37, 38, or 39 amino acids from the stem-like structure of the Hla polypeptide. Hla polypeptides that have a deletion of some or all amino acids of the stem-like structure may additionally have one or more amino acids inserted in the Hla polypeptide which do not naturally occur in the stem-like structure, or do not occur naturally occur in the stem-like structure at the location of the insertion of the amino acid. Amino acids which are inserted into the stem-like structure may contribute useful properties to an Hla polypeptide containing deleted amino acids of the stem-like structure, such as improved stability or immunogenicity of the Hla polypeptide. In some examples, 1, 2, 3, 4, 5, 6, 7, 8, 9, 10, 15, 20, 25, 30, or more amino acids may be inserted into the stem-like structure of an Hla polypeptide that has a deletion of some or all of the amino acids of the stem-like structure. In one example, the disclosure provides an isolated Hla polypeptide that has a deletion of 39 amino acids from the stem-like structure, and which contains an amino acid sequence of 4 amino acids inserted in the stem-like structure. In one example, an amino acid sequence PSGS (SEQ ID NO: 225) is inserted in the stem-like structure.

As used herein, when a Hla polypeptide is described as lacking "at least X (variable) amino acids" from the stem-like structure of the Hla polypeptide, this phrase refers to the total fewer amino acids that the Hla polypeptide has in the stem-like structure, as compared to the 39 amino acids of the stem-like structure of SEQ ID NO: 14. This number can be calculated according to the formula: 39−[(number of amino acids remaining in the stem-like structure after deletion of amino acids from the loop)+(number of amino acids inserted)]. For example, a Hla polypeptide which has 38 amino acids removed from the stem-like structure of the Hla polypeptide, but which also contains 5 inserted amino acids, is considered to be lacking 33 amino acids of the stem-like structure [39−(1+5)=33].

The disclosure further provides isolated Hla polypeptides which lack some or all amino acids of a stem-like structure in the Hla polypeptide, and that lack at least 1, 2, 3, 4, 5, 6, 7, 8, 9, 10, 11, 12, 13, 14, 15, 16, 17, 18, 19, 20, 21, 22, 23, 24, 25, or 26 amino acids of the N-terminal leader sequence. In one example, the disclosure provides an isolated Hla polypeptide that lacks at least 35 amino acids from the stem-like structure, and which has a deletion of 26 amino acids of the N-terminal leader sequence.

The disclosure further provides isolated Hla polypeptides, wherein the Hla polypeptide lacks at least 5, 10, 15, 20, 25, 30, 31, 32, 33, 34, 35, 36, 37, 38, or 39 amino acids from the stem-like structure, wherein the Hla polypeptide lacks at least 1, 2, 3, 4, 5, 6, 7, 8, 9, 10, 11, 12, 13, 14, 15, 16, 17, 18, 19, 20, 21, 22, 23, 24, 25, or 26 amino acids of the N-terminal leader sequence, and wherein the Hla polypeptide contains an amino acid sequence selected from (i) SEQ ID NO: 216; (ii) a sequence having at least 50%, 60%, 70%, 75%, 80%, 85%, 90%, 95%, 96%, 97%, 98%, or 99% identity to SEQ ID NO: 216; and (iii) a fragment containing (A) a sequence having 90%, 95%, 96%, 97%, 98%, or 99% or 100% identity to at least 7, 10, 15, 20, 25, 30, 40, 50, 60, 70, 80, 90, or 100 consecutive amino acids of amino acids 1-109 of SEQ ID NO: 216 and (B) a sequence having 90%, 95%, 96%, 97%, 98%, or 99% or 100% identity to at least 7, 10, 15, 20, 25, 30, 40, 50, 60, 70, 80, 90, or 100 consecutive amino acids of amino acids 114-258 of SEQ ID NO: 216.

In some aspects, Hla polypeptides provided herein that have a deletion of some or all amino acids of the stem-like structure in the Hla polypeptide may also have a mutation at the histidine residue corresponding to amino acid 61 of SEQ ID NO: 14. The histidine residue may be mutated to any amino acid which preserves the immunogenicity of the Hla antigen, while removing or reducing its toxic activity. The histidine may be mutated, for example, to an isoleucine, valine, leucine, or arginine residue.

Hla polypeptides provided herein that have a deletion of some or all amino acids of the stem-like structure in the Hla polypeptide may be capable of eliciting antibodies in a mammal which recognize naturally occurring Hla antigens of *S. aureus*.

Hla Polypeptides with a Mutation of the Tyrosine Residue Corresponding to Amino Acid 101 of SEQ ID NO: 231

In one embodiment, the inventors have identified *S. aureus* Hla polypeptides which are useful for immunisation which have a mutation of the tyrosine residue corresponding to amino acid 101 of SEQ ID NO: 231. Amino acid 101 of SEQ ID NO: 231 corresponds to amino acid 127 of SEQ ID NO: 14. Without being bound by theory, tyrosine 101 ("Y101") of an Hla polypeptide interacts directly with the histidine 35 ("H35"; residue 35 of SEQ ID NO: 231) of a neighboring Hla polypeptide in an Hla heptameric structure through hydrogen bonding, thereby contributing to the stability of an Hla heptamer. Thus, mutation of Y101 may impair the ability of Hla polypeptides to stably interact, and may inhibit the polymerization of Hla polypeptides.

Provided herein is an isolated Hla polypeptide, wherein the Hla polypeptide has a mutation of the tyrosine residue corresponding to amino acid 101 of SEQ ID NO: 231. Also provided herein is an isolated Hla polypeptide, wherein the Hla polypeptide has an alanine, glycine, isoleucine, leucine, or valine residue at the amino acid corresponding to amino acid 101 of SEQ ID NO: 231. In one example, an isolated Hla polypeptide with a leucine at the amino acid corresponding to amino acid 101 of SEQ ID NO: 231 is provided.

The disclosure further provides isolated Hla polypeptides with a mutation of the tyrosine residue corresponding to amino acid 101 of SEQ ID NO: 231, and that lack at least 1, 2, 3, 4, 5, 6, 7, 8, 9, 10, 11, 12, 13, 14, 15, 16, 17, 18, 19, 20, 21, 22, 23, 24, 25, or 26 amino acids of the N-terminal leader sequence corresponding to amino acids 1-26 of SEQ ID NO: 14. In one example, the disclosure provides an isolated Hla polypeptide that has a leucine at the amino acid corresponding to amino acid 101 of SEQ ID NO: 231, and which lacks 26 amino acids of the N-terminal leader sequence.

The disclosure further provides Hla polypeptides, wherein the Hla polypeptide has a mutation of the tyrosine residue corresponding to amino acid 101 of SEQ ID NO: 231, and wherein the Hla polypeptide contains an amino acid sequence selected from (i) SEQ ID NO: 242; (ii) a sequence having at least 50%, 60%, 70%, 75%, 80%, 85%, 90%, 95%, 96%, 97%, 98%, or 99% identity to SEQ ID NO: 242; and (iii) a fragment containing a sequence having 90%, 95%, 96%, 97%, 98%, or 99% or 100% identity to at least 7, 10, 15, 20, 25, 30, 40, 50, 60, 70, 80, 90, or 100 consecutive amino acids of SEQ ID NO: 242.

Hla polypeptides provided herein that have a mutation of the tyrosine residue corresponding to amino acid 101 of SEQ ID NO: 231 may be capable of eliciting antibodies in a mammal which recognize naturally occurring Hla antigens of *S. aureus*.

Immunogenic Compositions Containing Hla Polypeptides

The disclosure further provides for immunogenic compositions that contain any of the Hla polypeptides provided herein. In some examples, immunogenic compositions containing a Hla polypeptide have the Hla polypeptide as the sole antigen.

Immunogenic compositions that contain any of the Hla polypeptides provided herein may further contain one or more additional antigens. Additional antigens that may be provided with a Hla polypeptide include: (1) a sta006 antigen; (2) a sta011 antigen; (3) a esxA antigen; (4) a esxB antigen; (5) a sta081 antigen; (6) a ebpS antigen; (7) a efb antigen; (8) a emp antigen; (9) a esaC antigen; (10) a coA antigen; (11) a eap antigen; (12) a FnBA antigen; (13) a FnBB antigen; (14) a ebhA antigen; (15) a hlgB antigen; (16) a hlgC antigen; (17) a isdA antigen; (18) a isdB antigen; (19) a isdC antigen; (20) a isdG antigen; (21) a isdH antigen; (22) a isdI antigen; (23) a lukD antigen; (24) a lukE antigen; (25) a lukF antigen; (26) a lukS antigen; (27) a nuc antigen; (28) a sasA antigen; (29) a sasB antigen; (30) a sasC antigen; (31) a sasD antigen; (32) a sasF antigen; (33) a sdrC antigen; (34) a sdrD antigen; (35) a sdrE2 antigen; (36) a spa antigen; (37) a clfA antigen; (38) a clfB antigen; (39) a sta001 antigen; (40) a sta002 antigen; (41) a sta003 antigen; (42) a sta004 antigen; (43) a sta005 antigen; (44) a sta007 antigen; (45) a sta008 antigen; (46) a sta009 antigen; (47) a sta010 antigen; (48) a sta012 antigen; (49) a sta013 antigen; (50) a sta014 antigen; (51) a sta015 antigen (52) a sta016 antigen; (53) a sta017 antigen; (54) a sta018 antigen; (55) a sta019 antigen; (56) a sta020 antigen; (57) a sta021 antigen; (58) a sta022 antigen; (59) a sta023 antigen; (60) a sta024 antigen; (61) a sta025 antigen; (62) a sta026 antigen; (63) a sta027 antigen; (64) a sta028 antigen; (65) a sta029 antigen; (66) a sta030 antigen; (67) a sta031 antigen; (68) a sta032 antigen; (69) a sta033 antigen; (70) a sta034 antigen; (71) a sta035 antigen; (72) a sta036 antigen; (73) a sta037 antigen; (74) a sta038 antigen; (75) a sta039 antigen; (76) a sta040 antigen; (77) a sta041 antigen; (78) a sta042 antigen; (79) a sta043 antigen; (80) a sta044 antigen; (81) a sta045 antigen; (82) a sta046 antigen; (83) a sta047 antigen; (84) a sta048 antigen; (85) a sta049 antigen; (86) a sta050 antigen; (87) a sta051 antigen; (88) a sta052 antigen; (89) a sta053 antigen; (90) a sta054 antigen; (91) a sta055 antigen; (92) a sta056 antigen; (93) a sta057 antigen; (94) a sta058 antigen; (95) a sta059 antigen; (96) a sta060 antigen; (97) a sta061 antigen; (98) a sta062 antigen; (99) a sta063 antigen; (100) a sta064 antigen; (101) a sta065 antigen; (102) a sta066 antigen; (103) a sta067 antigen; (104) a sta068 antigen; (105) a sta069 antigen; (106) a sta070 antigen; (107) a sta071 antigen; (108) a sta072 antigen; (109) a sta073 antigen; (110) a sta074 antigen; (111) a sta075 antigen; (112) a sta076 antigen; (113) a sta077 antigen; (114) a sta078 antigen; (115) a sta079 antigen; (116) a sta080 antigen; (117) a sta082 antigen; (118) a sta083 antigen; (119) a sta084 antigen; (120) a sta085 antigen; (121) a sta086 antigen; (122) a sta087 antigen; (123) a sta088 antigen; (124) a sta089 antigen; (125) a sta090 antigen; (126) a sta091 antigen; (127) a sta092 antigen; (128) a sta093 antigen; (129) a sta094 antigen; (130) a sta095 antigen; (131) a sta096 antigen; (132) a sta097 antigen; (133) a sta098 antigen; (134) a sta099 antigen; (135) a sta100 antigen; (136) a sta101 antigen; (137) a sta102 antigen; (138) a sta103 antigen; (139) a sta104 antigen; (140) a sta105 antigen; (141) a sta106 antigen; (142) a sta107 antigen; (143) a sta108 antigen; (144) a sta109 antigen; (145) a sta110 antigen; (146) a sta111 antigen; (147) a sta112 antigen; (148) a sta113 antigen; (149) a sta114 antigen; (150) a sta115 antigen; (151) a sta116 antigen; (152) a sta117 antigen; (153) a sta118 antigen; (154) a sta119 antigen; (155) a sta120 antigen. Additional antigens that may be included with Hla polypeptides provided herein include:

(1) a clfA antigen which can elicit an antibody which recognises SEQ ID NO: 1 and contains an amino acid sequence: (a) having 80% or more identity to SEQ ID NO: 1; and/or (b) containing a fragment of at least 7 consecutive amino acids of SEQ ID NO: 1, wherein the fragment comprises an epitope from SEQ ID NO: 1, and (2) a polypeptide containing an amino acid sequence selected from the group consisting of (A) a sequence having at least 80% identity to SEQ ID NO: 151 and (B) a fragment having at least 7 consecutive amino acids from amino acids 1-97 of SEQ ID NO: 151 and at least 7 consecutive amino acids from amino acids 104-207 of SEQ ID NO: 151, wherein the polypeptide can elicit antibodies which recognise both the wild-type staphylococcal protein containing SEQ ID NO: 10 and the wild-type staphylococcal protein containing SEQ ID NO: 11.

Immunogenic compositions that contain any of the Hla polypeptides provided herein may further contain an adjuvant. In certain examples, immunogenic compositions that contain any of the Hla polypeptides provided herein may contain an aluminium hydroxide adjuvant, and optionally, a histidine buffer. Immunogenic compositions that contain any of the Hla polypeptides provided herein may further comprise: one or more conjugates of (i) a S. aureus expolysaccharide and (ii) a carrier protein and/or one or more conjugates of (i) a S. aureus capsular polysaccharide and (ii) a carrier protein.

Additional Polypeptides and Hla-related Nucleic Acids and Methods

Also provided herein is a polypeptide of formula NH$_2$-A-(-X-L-)$_n$-B—COOH, wherein: X is an amino acid sequence of a S. aureus antigen, selected from the group of: any Hla polypeptide provided herein having a deletion of some or all amino acids of the stem-like structure or any Hla polypeptide provided herein having a mutation of the tyrosine residue corresponding to amino acid 101 of SEQ ID NO: 231, sta006, sta011, esxA, esxB, clfA, clfB, coA, eap, ebhA, ebpS, efb, emp, esaC, FnBA, FnBB, hlgB, hlgC, isdA, isdB, isdC, isdG, isdH, isdI, lukD, lukE, lukF, lukS, nuc, sasA, sasB, sasC, sasD, sasF, sdrC, sdrD, sdrE2, spa, sta001, sta002, sta003, sta004, sta005, sta007, sta008, sta009, sta010, sta012, sta013, sta014, sta015, sta016, sta017, sta018, sta019, sta020, sta021, sta022, sta023, sta024, sta025, sta026, sta027, sta028, sta029, sta030, sta031, sta032, sta033, sta034, sta035, sta036, sta037, sta038, sta039, sta040, sta041, sta042, sta043, sta044, sta045, sta046, sta047, sta048, sta049, sta050, sta051, sta052, sta053, sta054, sta055, sta056, sta057, sta058, sta059, sta060, sta061, sta062, sta063, sta064, sta065, sta066, sta067, sta068, sta069, sta070, sta071, sta072, sta073, sta074, sta075, sta076, sta077, sta078, sta079, sta080, sta081, sta082, sta083, sta084, sta085, sta086, sta087, sta088, sta089, sta090, sta091, sta092, sta093, sta094, sta095, sta096, sta097, sta098, sta099, sta100, sta101, sta102, sta103, sta104, sta105, sta106, sta107, sta108, sta109, sta110, sta111, sta112, sta113, sta114, sta115, sta116, sta117, sta118, NW_6, NW_9, NW_10, NW_7, NW_8, NW_9, NW_2, NW_1, and NW_5; L is an optional linker amino acid sequence; A is an optional N-terminal amino acid sequence; B is an optional C-terminal amino acid sequence; and n is an integer of 2 or more. This polypeptide may be provided as part of an immunogenic composition. Immunogenic compositions containing this polypeptide may also contain one or more conjugates of (i) a S. aureus expolysaccharide and (ii) a carrier protein and/or one or more conjugates of (i) a S. aureus capsular polysaccharide and (ii) a carrier protein.

Further provided herein are nucleic acids that encode any Hla polypeptide provided herein having a deletion of some or all amino acids of the stem like structure or a mutation of the tyrosine residue corresponding to amino acid 101 of SEQ ID NO: 231.

The present disclosure also provides a method for raising an immune response in a mammal to a Hla antigen, which includes the step of administering to the mammal an effective amount of any Hla polypeptide provided herein having a deletion of some or all amino acids of the stem-like structure or having a mutation of the tyrosine residue corresponding to amino acid 101 of SEQ ID NO: 231.

Any of the Hla polypeptides provided herein having a deletion of some or all amino acids of the stem-like structure or having a mutation of the tyrosine residue corresponding to amino acid 101 of SEQ ID NO: 231 may also be used with any of the compositions or methods provided below that generically refer to a "Hla" antigen.

Combinations

The inventors have identified the following 36 polypeptides: clfA, clfB, coA, eap, ebhA, ebpS, efb, emp, esaC, esxA, esxB, FnBA, FnBB, Hla, hlgB, hlgC, isdA, isdB, isdC, isdG, isdH, isdI, lukD, lukE, lukF, lukS, nuc, sasA, sasB, sasC, sasD, sasF, sdrC, sdrD, spa, and sdrE2. This set of antigens is referred to herein as 'the first antigen group'. Thus the invention provides an immunogenic composition comprising a combination of antigens, said combination comprising two or more (i.e. 2, 3, 4, 5, 6 or more) antigens selected from the group consisting of: (1) a clfA antigen; (2) a clfB antigen; (3) a coA antigen; (4) a eap antigen; (5) a ebhA antigen; (6) a ebpS antigen; (7) a efb antigen; (8) a emp antigen; (9) a esaC antigen; (10) a esxA antigen; (11) a esxB antigen; (12) a FnBA antigen; (13) a FnBB antigen; (14) a Hla antigen; (15) a hlgB antigen; (16) hlgC antigen; (17) a isdA antigen; (18) a isdB antigen; (19) a isdC antigen; (20) a isdG antigen; (21) a isdH antigen; (22) a isdI antigen; (23) a lukD antigen; (24) a lukE antigen; (25) a lukF antigen; (26) a lukS antigen; (27) a nuc antigen; (28) a sasA antigen; (29) a sasB antigen; (30) a sasC antigen; (31) a sasD antigen; (32) a sasF antigen; (33) a sdrC antigen; (34) a sdrD antigen; (35) a spa antigen; (36) a sdrE2 antigen.

Within the first antigen group, antigens are preferably selected from a subset of 16 of the 36 polypeptides, namely: clfA, clfB, emp, esaC, esxA, esxB, hla, isdA, isdB, isdC, sasD, sasF, sdrC, sdrD, spa, and sdrE2. Thus the invention provides an immunogenic composition comprising a combination of antigens, said combination comprising two or more (i.e. 2, 3, 4, 5, 6 or more) antigens selected from the group consisting of these sixteen antigens.

The inventors have also identified the following 128 polypeptides: sta001, sta002, sta003, sta004, sta005, sta006, sta007, sta008, sta009, sta010, sta011, sta012, sta013, sta014, sta015, sta016, sta017, sta018, sta019, sta020, sta021, sta022, sta023, sta024, sta025, sta026, sta027, sta028, sta029, sta030, sta031, sta032, sta033, sta034, sta035, sta036, sta037, sta038, sta039, sta040, sta041, sta041, sta042, sta044, sta045, sta046, sta047, sta048, sta049, sta050, sta051, sta052, sta053, sta054, sta055, sta056, sta057, sta058, sta059, sta060, sta061, sta062, sta063, sta064, sta065, sta066, sta067, sta068, sta069, sta070, sta071, sta072, sta073, sta074, sta075, sta076, sta077, sta078, sta079, sta080, sta081, sta082, sta083, sta084, sta085, sta086, sta087, sta088, sta089, sta090, sta091, sta092, sta093, sta094, sta095, sta096, sta097, sta098, sta099, sta100, sta101, sta102, sta103, sta104, sta105, sta106, sta107, sta108, sta109, sta110, sta111, sta112, sta113, sta114, sta115, sta116, sta117, sta118, sta119, sta120, NW_6, NW_9, NW_10, NW_7, NW_8, NW_2, NW_1, and NW_5. This set of antigens is referred to herein as 'the second antigen group'. Thus the invention provides an immunogenic composition comprising a combination of antigens, said combination comprising two or more (i.e. 2, 3, 4, 5, 6 or more) antigens selected from the group consisting of: (1) a sta001 antigen; (2) a sta002 antigen; (3) a sta003 antigen; (4) a sta004 antigen; (5) a sta005 antigen; (6) a sta006 antigen; (7) a sta007 antigen; (8) a sta008 antigen; (9) a sta009 antigen; (10) a sta010 antigen; (11) a sta011 antigen; (12) a sta012, antigen; (13) a sta013 antigen; (14) a sta014 antigen; (15) a sta015 antigen; (16) a sta016 antigen; (17) a sta017 antigen; (18) a sta018 antigen; (19) a sta019 antigen; (20) a sta020 antigen; (21) a sta021 antigen; (22) a sta022 antigen; (23) a sta023 antigen; (24) a sta024 antigen; (25) a sta025 antigen; (26) a sta026 antigen; (27) a sta027 antigen; (28) a sta028 antigen; (29) a sta029 antigen; (30) a sta030 antigen; (31) a sta031 antigen; (32) a sta032 antigen; (33) a sta033 antigen; (34) a sta034 antigen; (35) a sta035 antigen; (36) a sta036 antigen; (37) a sta037 antigen; (38) a sta038 antigen; (39) a sta039 antigen; (40) a sta040 antigen; (41) a sta041 antigen; (42) a sta042 antigen; (43) a sta043 antigen; (44) a sta044 antigen; (45) a sta045 antigen; (46) a sta046 antigen; (47) a sta047 antigen; (48) a sta048 antigen; (49) a sta049 antigen; (50) a sta050 antigen; (51) a sta051 antigen; (52) a sta052 antigen; (53) a sta053 antigen; (54) a sta054 antigen; (55) a sta055 antigen; (56) a sta056 antigen; (57) a sta057 antigen; (58) a sta058 antigen; (59) a sta059 antigen; (60) a sta060 antigen; (61) a sta061 antigen; (62) a sta062 antigen; (63) a sta063 antigen; (64) a sta064 antigen; (65) a sta065 antigen; (66) a sta066 antigen; (67) a sta067 antigen; (68) a sta068 antigen; (69) a sta069 antigen; (70) a sta070 antigen; (71) a sta071 antigen; (72) a sta072 antigen; (73) a sta073 antigen; (74) a sta074 antigen; (75) a sta075 antigen; (76) a sta076 antigen; (77) a sta077 antigen; (78) a sta078 antigen; (79) a sta079 antigen; (80) a sta080 antigen; (81) a sta081 antigen; (82) a sta082 antigen; (83) a sta083 antigen; (84) a sta084 antigen; (85) a sta085 antigen; (86) a sta086 antigen; (87) a sta087 antigen; (88) a sta088 antigen; (89) a sta089 antigen; (90) a sta090 antigen; (91) a sta091 antigen; (92) a sta092 antigen; (93) a sta093 antigen; (94) a sta094 antigen; (95) a sta095 antigen; (96) a sta096 antigen; (97) a sta097 antigen; (98) a sta098 antigen; (99) a sta099 antigen; (100) a sta100 antigen; (101) a sta101 antigen; (102) a sta102 antigen; (103) a sta103 antigen; (104) a sta104 antigen; (105) a sta105 antigen; (106) a sta106 antigen; (107) a sta107 antigen; (108) a sta108 antigen; (109) a sta109 antigen; (110) a sta110 antigen; (111) a sta111 antigen; (112) a sta112 antigen; (113) a sta113 antigen; (114) a sta114 antigen; (115) a sta115 antigen; (116) a sta116 antigen; (117) a sta117 antigen; (118) a sta118 antigen; (119) a sta119 antigen; (120) a sta120 antigen; (121) a NW_6 antigen; (122) a NW_9 antigen; (123) a NW_10 antigen; (124) a NW_7 antigen; (125) a NW_8 antigen; (126) a NW_2 antigen; (127) a NW_1 antigen; and (128) a NW_5 antigen.

Within the second antigen group of 128 antigens, a preferred subset of 113 antigens omits (81) and (107) to (120) from this list.

Within the second antigen group, a subset of 27 of the 128 polypeptides is referred to herein as 'the third antigen group', namely: sta001, sta002, sta003, sta004, sta005, sta006, sta007, sta008, sta009, sta010, sta019, sta028, sta040, sta049, sta057, sta064, sta073, sta095, sta098, sta101, sta105, NW_1, NW_6, NW_7, NW_8, NW_9 and NW_10. The invention provides an immunogenic composition comprising a combination of antigens, said combination comprising two or more (i.e. 2, 3, 4, 5, 6 or more) antigens selected from the third antigen group.

The 101 antigens that are in the second antigen group but not in the third antigen group are referred to herein as 'the fourth antigen group'. Within the fourth antigen group of 101 antigens, a preferred subset of 86 antigens omits (81) and (107) to (120) from the above list. The second antigen group thus consists of a combination of the third and fourth antigen groups.

Within the second antigen group, a subset of 8 of the 128 polypeptides is referred to herein as 'the fifth antigen group', namely: sta004, sta006, sta007, sta011, sta028, sta060, sta098 and sta112. The invention provides an immunogenic composition comprising a combination of antigens, said combination comprising two or more (i.e. 2, 3, 4, 5, 6 or more) antigens selected from the fifth antigen group.

Within the 36 antigens of the first antigen group there are 630 possible pairs of different antigens. All such pairs are disclosed herein and are part of the invention. Thus the invention provides an immunogenic composition comprising a pair of antigens, wherein said pair is one of said 630 pairs.

Within the 128 antigens of the second antigen group there are 8128 possible pairs of different antigens. All such pairs are disclosed herein and are part of the invention. Thus the invention provides an immunogenic composition comprising a pair of antigens, wherein said pair is one of said 8128 pairs.

Within the preferred 113 antigens of the second antigen group there are 6328 possible pairs of different antigens. All such pairs are disclosed herein and are part of the invention. Thus the invention provides an immunogenic composition comprising a pair of antigens, wherein said pair is one of said 6328 pairs.

Within the preferred 27 antigens of the third antigen group there are 351 possible pairs of different antigens. All such pairs are disclosed herein and are part of the invention. Thus the invention provides an immunogenic composition comprising a pair of antigens, wherein said pair is one of said 351 pairs.

Within the 101 antigens of the fourth antigen group there are 5050 possible pairs of different antigens. All such pairs are disclosed herein and are part of the invention. Thus the invention provides an immunogenic composition comprising a pair of antigens, wherein said pair is one of said 5050 pairs.

Within the preferred 86 antigens of the fourth antigen group there are 3655 possible pairs of different antigens. All such pairs are disclosed herein and are part of the invention. Thus the invention provides an immunogenic composition comprising a pair of antigens, wherein said pair is one of said 3655 pairs.

In one embodiment, a composition includes at least one antigen (i.e. 1, 2, 3, 4, 5, 6 or more) selected from the first antigen group and at least one antigen (i.e. 1, 2, 3, 4, 5 or more) selected from the second antigen group. Antigens from the first antigen group may be selected from the preferred subset of 16 antigens, and antigens from the second antigen group may be selected from the third antigen group or the fifth antigen group.

The invention also provides an immunogenic composition comprising a combination of antigens, said combination comprising two or more (i.e. 2, 3, 4, 5, 6 or more) antigens selected from the group consisting of: (1) a clfA antigen; (2) a clfB antigen; (3) a sdrE2 antigen; (4) a sdrC antigen; (5) a SasF antigen; (6) a emp antigen; (7) a sdrD antigen; (8) a spa antigen; (9) a esaC antigen; (10) a esxA antigen; (11) a esxB antigen; (12) a sta006 antigen; (13) a isdC antigen; (14) a hla antigen; (15) a sta011 antigen; (16) isdA antigen; (17) a isdB antigen; (18) a sasF antigen. This group of 18 antigens is sometimes referred to herein as the 'sixth antigen group'.

The invention also provides an immunogenic composition comprising a combination of antigens, said combination comprising two or more (i.e. 2, 3, 4 or 5) antigens selected from the group consisting of: (1) a esxA antigen; (2) a esxB antigen; (3) a sta006 antigen; (4) a hla antigen; and/or (5) a sta011 antigen. The composition may also include an adjuvant e.g. an aluminium hydroxide adjuvant.

Advantageous combinations of the invention are those in which two or more antigens act synergistically. Thus the protection against *S. aureus* disease achieved by their combined administration exceeds that expected by mere addition of their individual protective efficacy.

Specific combinations of interest include, but are not limited to:

(1) An immunogenic composition comprising a sdrD antigen, a sdrE2 antigen and a isdC antigen. The sdrD and sdrE2 antigens can usefully be combined as a hybrid polypeptide, as discussed below, e.g. an SdrDE hybrid with an sdrE2 antigen downstream of a sdrD antigen.

(2) An immunogenic composition comprising a sasD antigen, a clfB antigen and a sdrC antigen.

(3) An immunogenic composition comprising a sasD antigen, a clfB antigen, a sdrC antigen and a clfA antigen.

(4) An immunogenic composition comprising a sdrD antigen, a sdrE2 antigen, a isdC antigen and a sta011 antigen. The sdrD and sdrE2 antigens can usefully be combined as a hybrid polypeptide, as discussed below, e.g. a SdrDE hybrid with a sdrE2 antigen downstream of a sdrD antigen.

(5) An immunogenic composition comprising a sasD antigen, a clfB antigen, a sdrC antigen and a sta006 antigen.

(6) An immunogenic composition comprising a sdrD antigen, a sdrE2 antigen, a isdC antigen and a hla antigen. The sdrD and sdrE2 antigens can usefully be combined as a hybrid polypeptide, as discussed below, e.g. a SdrDE hybrid with a sdrE2 antigen downstream of a sdrD antigen. The Hla antigen may be a detoxified mutant e.g. including a H35L mutation.

(7) An immunogenic composition comprising a sasD antigen, a clfB antigen, a sdrC antigen and a esxA antigen.

(8) An immunogenic composition comprising a esxA antigen, a esxB antigen, a sta006 antigen and a hla antigen. The esxA and esxB antigens can usefully be combined as a hybrid polypeptide, as discussed below, e.g. a EsxAB hybrid with a esxB antigen downstream of a esxA antigen. The Hla antigen may be a detoxified mutant e.g. including a H35L mutation.

(9) An immunogenic composition comprising a sdrD antigen, a sdrE2 antigen, a isdC antigen and a esxA antigen. The sdrD and sdrE2 antigens can usefully be combined as a hybrid polypeptide, as discussed below, e.g. a SdrDE hybrid with a sdrE2 antigen downstream of a sdrD antigen.

(10) An immunogenic composition comprising a esxA antigen, a esxB antigen, a sta006 antigen and a sta011 antigen. The esxA and esxB antigens may be combined as a hybrid polypeptide, as discussed below, e.g. an EsxAB hybrid.

(11) An immunogenic composition comprising a esxA antigen, a esxB antigen and a sta011 antigen. The esxA and esxB antigens can usefully be combined as a hybrid polypeptide, as discussed below, e.g. a EsxAB hybrid with a esxB antigen downstream of a esxA antigen.

(12) An immunogenic composition comprising a sasD antigen, a clfB antigen, a sdrC antigen and a spa antigen.

(13) An immunogenic composition comprising a esxA antigen, a esxB antigen, a isdA antigen, a sta006 antigen, a sta011 antigen and a spa antigen. The esxA and esxB antigens may be combined as a hybrid polypeptide, as discussed below, e.g. an EsxAB hybrid. The isdA antigen may be a fragment of a full-length isdA antigen e.g. SEQ ID NO: 157. The spa antigen may be a fragment of a full-length spa antigen, such as a Spa(D) domain mutated to disrupt or decrease binding to IgG Fc.

(14) An immunogenic composition comprising a esxA antigen, a esxB antigen, a Hla antigen, a sta006 antigen and a sta011 antigen. The esxA and esxB antigens may be combined as a hybrid polypeptide, as discussed below, e.g. an EsxAB hybrid. The Hla antigen may be a detoxified mutant e.g. including a H35L mutation.

(15) An immunogenic composition comprising a sdrD antigen, a sdrE2 antigen, a isdC antigen and a sdrE2 antigen. The sdrD and sdrE2 antigens can usefully be combined as a hybrid polypeptide, as discussed below, e.g. a SdrDE hybrid with a sdrE2 antigen downstream of a sdrD antigen.

(16) An immunogenic composition comprising a esxA antigen, a esxB antigen and a hla antigen. The esxA and esxB antigens can usefully be combined as a hybrid polypeptide, as discussed below, e.g. a EsxAB hybrid with a esxB antigen downstream of a esxA antigen. The Hla antigen may be a detoxified mutant e.g. including a H35L mutation.

(17) An immunogenic composition comprising a hla antigen, a isdA antigen, a sta006 antigen and a sta011 antigen. The isdA antigen may be a fragment of a full-length isdA antigen e.g. SEQ ID NO: 157. The Hla antigen may be a detoxified mutant e.g. including a H35L mutation.

(18) An immunogenic composition comprising a esxA antigen, a esxB antigen, a sta006 antigen and a isdA antigen. The esxA and esxB antigens can usefully be combined as a hybrid polypeptide, as discussed below, e.g. a EsxAB hybrid with a esxB antigen downstream of a esxA antigen. The isdA antigen may be a fragment of a full-length isdA antigen e.g. SEQ ID NO: 157.

(19) An immunogenic composition comprising a sasD antigen, a clfB antigen, a sdrC antigen and a hla antigen. The Hla antigen may be a detoxified mutant e.g. including a H35L mutation.

(20) An immunogenic composition comprising a Hla antigen, a sta006 antigen and a sta011 antigen. The Hla antigen may be a detoxified mutant e.g. including a H35L mutation.

(21) An immunogenic composition comprising a esxA antigen and a esxB antigen. The esxA and esxB antigens can usefully be combined as a hybrid polypeptide, as discussed below, e.g. an EsxAB hybrid with an esxB antigen downstream of an esxA antigen.

(22) An immunogenic composition comprising a esxA antigen, a esxB antigen and a sta006 antigen. The esxA and esxB antigens can usefully be combined as a hybrid polypeptide, as discussed below, e.g. a EsxAB hybrid with a esxB antigen downstream of a esxA antigen.

(23) An immunogenic composition comprising a spa antigen, a sta006 antigen and a sta011 antigen. The spa antigen may be a fragment of a full-length spa antigen, such as a Spa(D) domain mutated to disrupt or decrease binding to IgG Fc.

(24) An immunogenic composition comprising a esxA antigen, a esxB antigen, a isdA antigen, a sta006 antigen and a sta011 antigen. The esxA and esxB antigens may be combined as a hybrid polypeptide, as discussed below, e.g. an EsxAB hybrid. The isdA antigen may be a fragment of a full-length isdA antigen e.g. SEQ ID NO: 157.

(25) An immunogenic composition comprising a sta006 antigen and a sta011 antigen.

(26) An immunogenic composition comprising a esxA antigen, a esxB antigen, a sta006 antigen, a isdA antigen and a clfB antigen. The esxA and esxB antigens can usefully be combined as a hybrid polypeptide, as discussed below, e.g. a EsxAB hybrid with a esxB antigen downstream of a esxA antigen. The isdA antigen may be a fragment of a full-length isdA antigen e.g. SEQ ID NO: 157. The clfB antigen may be a fragment of a full-length clfB antigen e.g. SEQ ID NO: 163.

(27) An immunogenic composition comprising a sta006 antigen, a sta011 antigen and a sta019 antigen.

(28) An immunogenic composition comprising a esxA antigen, a esxB antigen, a sta006 antigen, a hla antigen and a clfB antigen. The esxA and esxB antigens can usefully be combined as a hybrid polypeptide, as discussed below, e.g. a EsxAB hybrid with a esxB antigen downstream of a esxA antigen. The clfB antigen may be a fragment of a full-length clfB antigen e.g. SEQ ID NO: 163. The Hla antigen may be a detoxified mutant e.g. including a H35L mutation.

(29) An immunogenic composition comprising a sta006 antigen, a sta011 antigen, a sta019 antigen, and a hla antigen. The Hla antigen may be a detoxified mutant e.g. including a H35L mutation.

(30) An immunogenic composition comprising a esxA antigen, a esxB antigen, a sta006 antigen, a sta011 antigen and a clfB antigen. The esxA and esxB antigens can usefully be combined as a hybrid polypeptide, as discussed below, e.g. a EsxAB hybrid with a esxB antigen downstream of a esxA antigen. The clfB antigen may be a fragment of a full-length clfB antigen e.g. SEQ ID NO: 163.

(31) An immunogenic composition comprising a spa antigen, a esxA antigen, a esxB antigen, a sta006 antigen and a sta011 antigen. The spa antigen may be a fragment of a full-length spa antigen, such as a Spa(D) domain mutated to disrupt or decrease binding to IgG Fc. The esxA and esxB antigens may be combined as a hybrid polypeptide, as discussed below, e.g. an EsxAB hybrid.

(32) An immunogenic composition comprising a sdrD antigen, a sdrE2 antigen, a isdC antigen and a esxB antigen. The sdrD and sdrE2 antigens can usefully be combined as a hybrid polypeptide, as discussed below, e.g. a SdrDE hybrid with a sdrE2 antigen downstream of a sdrD antigen.

(33) An immunogenic composition comprising a esxA antigen, a esxB antigen, a sta006 antigen, a sta011 antigen and a sta019 antigen. The esxA and esxB antigens can usefully be combined as a hybrid polypeptide, as discussed below, e.g. a EsxAB hybrid with a esxB antigen downstream of a esxA antigen.

(34) An immunogenic composition comprising a esxA antigen, a esxB antigen, a sta006 antigen, a isdA antigen and a sdrD antigen. The esxA and esxB antigens can usefully be combined as a hybrid polypeptide, as discussed below, e.g. a EsxAB hybrid with a esxB antigen downstream of a esxA antigen. The isdA antigen may be a fragment of a full-length isdA antigen e.g. SEQ ID NO: 157. The sdrD antigen may be a fragment of a full-length sdrD antigen e.g. SEQ ID NO: 156.

(35) An immunogenic composition comprising a esxA antigen, a esxB antigen, and a isdA antigen. The esxA and esxB antigens can usefully be combined as a hybrid polypeptide, as discussed below, e.g. a EsxAB hybrid with a esxB antigen downstream of a esxA antigen. The isdA antigen may be a fragment of a full-length isdA antigen e.g. SEQ ID NO: 157.

(36) An immunogenic composition comprising a sasD antigen, a clfB antigen, a sdrC antigen, a esxA antigen and a esxB antigen. The esxA and esxB antigens can usefully be combined as a hybrid polypeptide, as discussed below, e.g. an EsxAB hybrid with an esxB antigen downstream of an esxA antigen.

(37) An immunogenic composition comprising a Hla antigen, a spa antigen, a sta006 antigen and a sta011 antigen. The Hla antigen may be a detoxified mutant e.g. including a H35L mutation. The spa antigen may be a fragment of a full-length spa antigen, such as a Spa(D) domain mutated to disrupt or decrease binding to IgG Fc.

In some embodiments, any of these 37 compositions may include additional staphylococcal antigens, and these further antigens can be polypeptides and/or saccharides. For example, they can usefully also include one or more S. aureus capsular saccharide conjugate(s) e.g. against a serotype 5 and/or a serotype 8 strain. The inclusion of one or both such conjugates is particularly useful for combinations (8), (10), (20), (23), (25), (31) and (37).

In other embodiments, these 37 compositions include no additional staphylococcal polypeptide antigens. In other embodiments, these 37 compositions include no additional staphylococcal antigens. In other embodiments, these 37 compositions include no additional antigens.

The invention also provides a polypeptide comprising amino acid sequence (a) having 80% or more identity (e.g. 80%, 85%, 90%, 91%, 92%, 93%, 94%, 95%, 96%, 97%, 98%, 99%, 99.5% or more) to SEQ ID NO: 151; and/or (b) comprising a fragment of at least 'n' consecutive amino acids from amino acids 1-97 of SEQ ID NO: 151 and at least 'n' consecutive amino acids from amino acids 104-207 of SEQ ID NO: 151, wherein 'n' is 7 or more (e.g. 8, 10, 12, 14, 16, 18, 20, 25, 30, 35, 40, 50, 60, 70, 80, 90, 100, 150, 200, 250 or more). The invention also provides a polypeptide comprising amino acid sequence (a) having 80% or more identity (e.g. 80%, 85%, 90%, 91%, 92%, 93%, 94%, 95%, 96%, 97%, 98%, 99%, 99.5% or more) to SEQ ID NO: 152; and/or (b) comprising a fragment of at least 'n' consecutive amino acids from amino acids 1-104 of SEQ ID NO: 152 and at least 'n' consecutive amino acids from amino acids 111-207 of SEQ ID NO: 152, wherein 'n' is 7 or more (e.g. 8, 10, 12, 14, 16, 18, 20, 25, 30, 35, 40, 50, 60, 70, 80, 90, 100, 150, 200, 250 or more). These polypeptides can elicit antibodies (e.g. when administered to a human) which recognise both the wild-type staphylococcal protein comprising SEQ ID NO: 10 and the wild-type staphylococcal protein comprising SEQ ID NO: 11. Thus the immune response will recognise both of antigens esxA and esxB. Preferred fragments of (b) provide an epitope from SEQ ID NO: 10 and an epitope from SEQ ID NO: 11. The invention also provides an immunogenic composition comprising a combination of such a protein and an adjuvant, such as an aluminium hydroxide adjuvant.

The invention also provides a polypeptide comprising amino acid sequence (a) having 80% or more identity (e.g. 80%, 85%, 90%, 91%, 92%, 93%, 94%, 95%, 96%, 97%, 98%, 99%, 99.5% or more) to SEQ ID NO: 241; and/or (b) comprising both a fragment of at least 'n' consecutive amino acids from amino acids 1-96 of SEQ ID NO: 241 and a fragment of at least 'n' consecutive amino acids from amino acids 103-205 of SEQ ID NO: 241, wherein 'n' is 7 or more (e.g. 8, 10, 12, 14, 16, 18, 20, 25, 30, 35, 40, 50, 60, 70, 80, 90, 100, 150, 200, 250 or more). These polypeptides (e.g. SEQ ID NO: 250) can elicit antibodies (e.g. when administered to a human) which recognise both the wild-type staphylococcal protein comprising SEQ ID NO: 10 and the wild-type staphylococcal protein comprising SEQ ID NO: 11. Thus the immune response will recognise both of antigens esxA and esxB. Preferred fragments of (b) provide an epitope from SEQ ID NO: 10 and an epitope from SEQ ID NO: 11. The invention also provides an immunogenic composition comprising a combination of such a protein and an adjuvant, such as an aluminium hydroxide adjuvant.

The invention also provides a polypeptide comprising a staphylococcal hemolysin sequence, wherein the sequence does not include a sequence having at least 90% identity to SEQ ID NO: 217 but can elicit antibodies which can kill staphylococci. The polypeptide may have a first sequence having 80% or more identity (e.g. 80%, 85%, 90%, 91%, 92%, 93%, 94%, 95%, 96%, 97%, 98%, 99%, 99.5% or more) to SEQ ID NO: 218 and a second sequence having 80% or more identity (e.g. 80%, 85%, 90%, 91%, 92%, 93%, 94%, 95%, 96%, 97%, 98%, 99%, 99.5% or more) to SEQ ID NO: 219, wherein the first and second sequences are either directly joined or are joined by an intervening amino acid sequence having fewer than 40 amino acids (e.g. ≤35 amino acids, ≤30 amino acids, ≤25 amino acids, ≤20 amino acids, ≤15 amino acids, ≤10 amino acids, ≤5 amino acids). SEQ ID NOs: 189 and 216 are examples of such polypeptides, in which the first and second sequences are joined by a tetrapeptide PSGS sequence (SEQ ID NO: 225).

The invention also provides an immunogenic composition comprising a Sta011 antigen and a $Ca^{++}$ ion. The antigen and $Ca^{++}$ ion may form a complex e.g. atoms in the antigen may coordinate the $Ca^{++}$ ion. The immunogenic composition may also include an adjuvant.

The invention also provides a oligomer of a Sta011 antigen, and also immunogenic compositions comprising such oligomers. The oligomer can be a dimer, trimer, tetramer, pentamer, hexamer, heptamer, octamer or higher. An oligomer may comprise a $Ca^{++}$ ion, and a composition comprising Sta011 oligomers may comprise 5-500 mM $Ca^{++}$ ions.

Further Polypeptide Antigens

In additions to antigens from the various antigen groups and/or Hla polypeptides provided herein having a deletion of some or all amino acids of the stem-like structure (the "loop-deleted Hla polypeptide") or having a mutation of the tyrosine residue corresponding to amino acid 101 of SEQ ID NO: 231 of the invention, immunogenic compositions may include one or more of the following S. aureus antigens (or antigens comprising immunogenic fragment(s) thereof) to enhance the efficacy against S. aureus of an immune response elicited by the composition [e.g. see references 3-10]:

AhpC
AhpF
Autolysin amidase
Autolysin glucosaminidase
Collagen binding protein CAN
EbhB
GehD lipase
Heparin binding protein HBP (17 kDa)
Laminin receptor
MAP
MntC (also known as SitC)
MRPII
Npase
ORF0594
ORF0657n
ORF0826
PBP4
RAP (RNA III activating protein)
Sai-1
SasK
SBI
SdrG
SdrH
SSP-1
SSP-2
Vitronectin-binding protein Combinations With Saccharides The individual antigens identified in the antigen groups and/or the loop-deleted Hla polypeptides and/or the Hla polypeptides having a mutation of the tyrosine residue corresponding to amino acid 101 of SEQ ID NO: 231 of the invention may be used in combination with conjugated saccharide antigens. Thus the invention provides an immunogenic composition comprising a combination of:

(1) one or more antigen(s) selected from the first, second, third or fourth antigen groups or the loop-deleted Hla polypeptides and/or the Hla polypeptides having a mutation of the tyrosine residue corresponding to amino acid 101 of SEQ ID NO: 231 (as defined above); and (2) one or more conjugates of a S. aureus exopolysaccharide and a carrier protein.

Thus the invention further provides an immunogenic composition comprising a combination of:

(1) a loop-deleted Hla polypeptide and/or a Hla polypeptide having a mutation of the tyrosine residue corresponding to amino acid 101 of SEQ ID NO: 231 and optionally one or more antigen(s) selected from the first, second, third or fourth antigen groups (as defined above); and (2) one or more conjugates of a S. aureus exopolysaccharide and a carrier protein.

A conjugate used in component (2) of this combination includes a saccharide moiety and a carrier moiety. The saccharide moiety is from the exopolysaccharide of S. aureus, which is a poly-N-acetylglucosamine (PNAG). The saccharide may be a polysaccharide having the size that arises during purification of the exopolysaccharide from bacteria, or it may be an oligosaccharide achieved by fragmentation of such a polysaccharide e.g. size can vary from over 400 kDa to between 75 and 400 kDa, or between 10 and 75 kDa, or up to 30 repeat units. The saccharide moiety can have various degrees of N-acetylation and, as described in reference 11, the PNAG may be less than 40% N-acetylated (e.g. less than 35, 30, 20, 15, 10 or 5% N-acetylated; deacetylated PNAG is also known as dPNAG). Deacetylated epitopes of PNAG can elicit antibodies that are capable of mediating opsonic killing. The PNAG may or may not be O-succinylated e.g. it may be O-succinylated on fewer less than 25, 20, 15, 10, 5, 2, 1 or 0.1% of residues.

The invention also provides an immunogenic composition comprising a combination of:

(1) one or more antigen(s) selected from the first, second, third or fourth antigen groups; and (2) one or more conjugates of a S. aureus capsular saccharide and a carrier protein.

The invention additionally provides an immunogenic composition comprising a combination of:
  (1) a loop-deleted Hla polypeptide and optionally one or more antigen(s) selected from the first, second, third or fourth antigen groups; and
  (2) one or more conjugates of a *S. aureus* capsular saccharide and a carrier protein.

The invention additionally provides an immunogenic composition comprising a combination of:
  (1) an Hla polypeptide having a mutation of the tyrosine residue corresponding to amino acid 101 of SEQ ID NO: 231 and optionally one or more antigen(s) selected from the first, second, third or fourth antigen groups; and
  (2) one or more conjugates of a *S. aureus* capsular saccharide and a carrier protein.

A conjugate used in component (2) of this combination includes a saccharide moiety and a carrier moiety. The saccharide moiety is from the capsular saccharide of a *S. aureus*. The saccharide may be a polysaccharide having the size that arises during purification of capsular polysaccharide from bacteria, or it may be an oligosaccharide achieved by fragmentation of such a polysaccharide. Capsular saccharides may be obtained from any suitable strain of *S. aureus* (or any bacterium having a similar or identical saccharide), such as from a type 5 and/or a type 8 *S. aureus* strain and/or a type 336 *S. aureus* strain. Most strains of infectious *S. aureus* contain either Type 5 or Type 8 capsular saccharides. Both have FucNAcp in their repeat unit as well as ManNAcA which can be used to introduce a sulfhydryl group for linkage. The repeating unit of the Type 5 saccharide is →4)-β-D-ManNAcA-(1→4)-α-L-FucNAc(3OAc)-(1→3)-β-D-FucNAc-(1→, whereas the repeating unit of the Type 8 saccharide is →3)-β-D-ManNAcA(4OAc)-(1→3)-α-L-FucNAc(1→3)-α-D-FucNAc(1→. The type 336 saccharide is a β-linked hexosamine with no O-acetylation [12,13] and is cross-reactive with antibodies raised against the 336 strain (ATCC 55804). A combination of a type 5 and a type 8 saccharide is typical, and a type 336 saccharide may be added to this pairing [14].

The invention also provides an immunogenic composition comprising a combination of:
  (1) one or more antigen(s) selected from the first, second, third or fourth antigen groups;
  (2) one or more conjugates of a *S. aureus* exopolysaccharide and a carrier protein; and
  (3) one or more conjugates of a *S. aureus* capsular saccharide and a carrier protein.

The invention additionally provides an immunogenic composition comprising a combination of:
  (1) a loop-deleted Hla polypeptides and optionally one or more antigen(s) selected from the first, second, third or fourth antigen groups;
  (2) one or more conjugates of a *S. aureus* exopolysaccharide and a carrier protein; and
  (3) one or more conjugates of a *S. aureus* capsular saccharide and a carrier protein.

The invention additionally provides an immunogenic composition comprising a combination of:
  (1) a Hla polypeptide having a mutation of the tyrosine residue corresponding to amino acid 101 of SEQ ID NO: 231 and optionally one or more antigen(s) selected from the first, second, third or fourth antigen groups;
  (2) one or more conjugates of a *S. aureus* exopolysaccharide and a carrier protein; and
  (3) one or more conjugates of a *S. aureus* capsular saccharide and a carrier protein.

The carrier moiety in these conjugates will usually be a protein, but usually not one of the antigens of (1). Typical carrier proteins are bacterial toxins, such as diphtheria or tetanus toxins, or toxoids or mutants or fragments thereof. The CRM197 diphtheria toxin mutant [15] is useful. Other suitable carrier proteins include the *N. meningitidis* outer membrane protein complex [16], synthetic peptides [17,18], heat shock proteins [19,20], pertussis proteins [21,22], cytokines [23], lymphokines [23], hormones [23], growth factors [23], artificial proteins comprising multiple human CD4+ T cell epitopes from various pathogen-derived antigens [24] such as N19 [25], protein D from *H. influenzae* [26-28], pneumolysin [29] or its non-toxic derivatives [30], pneumococcal surface protein PspA [31], iron-uptake proteins [32], toxin A or B from *C. difficile* [33], recombinant *P. aeruginosa* exoprotein A (rEPA) [34], etc. In some embodiments the carrier protein is a *S. aureus* protein, such as an antigen selected from the first, second, third or fourth antigen groups.

Where a composition includes more than one conjugate, each conjugate may use the same carrier protein or a different carrier protein.

Conjugates may have excess carrier (w/w) or excess saccharide (w/w). In some embodiments, a conjugate may include substantially equal weights of each.

The carrier molecule may be covalently conjugated to the carrier directly or via a linker. Direct linkages to the protein may be achieved by, for instance, reductive amination between the saccharide and the carrier, as described in, for example, references 35 and 36. The saccharide may first need to be activated e.g. by oxidation. Linkages via a linker group may be made using any known procedure, for example, the procedures described in references 37 and 38. A preferred type of linkage is an adipic acid linker, which may be formed by coupling a free —$NH_2$ group (e.g. introduced to a glucan by amination) with adipic acid (using, for example, diimide activation), and then coupling a protein to the resulting saccharide-adipic acid intermediate [39,40]. Another preferred type of linkage is a carbonyl linker, which may be formed by reaction of a free hydroxyl group of a saccharide CDI [41,42] followed by reaction with a protein to form a carbamate linkage. Other linkers include β-propionamido [43], nitrophenyl-ethylamine [44], haloacyl halides [45], glycosidic linkages [46], 6-aminocaproic acid [47], ADH [48], $C_4$ to $C_{12}$ moieties [49], etc. Carbodiimide condensation can also be used [50].

PNAG conjugates may be prepared in various ways e.g. by a process comprising: a) activating the PNAG by adding a linker comprising a maleimide group to form an activated PNAG; b) activating the carrier protein by adding a linker comprising a sulphydryl group to form an activated carrier protein; and c) reacting the activated PNAG and the activated carrier protein to form a PNAG-carrier protein conjugate; or by a process comprising a) activating the PNAG by adding a linker comprising a sulphydryl group to form an activated PNAG; b) activating the carrier protein by adding a linker comprising a maleimide group to form an activated carrier protein; and c) reacting the activated PNAG and the activated carrier protein to form a PNAG-carrier protein conjugate; or by a process comprising a) activating the PNAG by adding a linker comprising a sulphydryl group to form an activated PNAG; b) activating the carrier protein by adding a linker comprising a sulphydryl group to form an activated carrier protein; and c) reacting the activated PNAG and the activated carrier protein to form a PNAG-carrier protein conjugate.

The individual antigens identified in the antigen groups of the invention may be used as carrier proteins for exopolysaccharides, to form a covalent conjugate. Thus the invention provides an immunogenic composition comprising a conjugate of (1) an antigen selected from the first, second, third and fourth antigen groups and (2) a *S. aureus* exopolysaccharide. The invention also provides an immunogenic composition comprising a conjugate of (1) an antigen selected from the first, second, third and fourth antigen groups and (2) a *S. aureus* capsular saccharide. Further characteristics of such conjugates are described above. These conjugates may be combined with any of the antigens disclosed herein.

Combinations with Non-Staphylococcal Antigens

The individual antigens identified in the antigen groups and/or the loop-deleted Hla polypeptides and/or the Hla polypeptides having a mutation of the tyrosine residue corresponding to amino acid 101 of SEQ ID NO: 231 of the invention may be used in combination with non-staphylococcal antigens, and in particular with antigens from bacteria associated with nosocomial infections. Thus the invention provides an immunogenic composition comprising a combination of:
(1) one or more antigen(s) selected from the first, second, third and fourth antigen groups (as defined above); and
(2) one or more antigen(s) selected from the group consisting of: *Clostridium difficile*; *Psuedomonas aeruginosa*; *Candida albicans*; and extraintestinal pathogenic *Escherichia coli*.

Thus the invention further provides an immunogenic composition comprising a combination of:
(1) a loop-deleted Hla polypeptide and optionally one or more antigen(s) selected from the first, second, third and fourth antigen groups (as defined above); and
(2) one or more antigen(s) selected from the group consisting of: *Clostridium difficile*; *Psuedomonas aeruginosa*; *Candida albicans*; and extraintestinal pathogenic *Escherichia coli*.

Thus the invention further provides an immunogenic composition comprising a combination of:
(1) a Hla polypeptide having a mutation of the tyrosine residue corresponding to amino acid 101 of SEQ ID NO: 231 and optionally one or more antigen(s) selected from the first, second, third and fourth antigen groups (as defined above); and
(2) one or more antigen(s) selected from the group consisting of: *Clostridium difficile*; *Psuedomonas aeruginosa*; *Candida albicans*; and extraintestinal pathogenic *Escherichia coli*.

Further suitable antigens for use in combination with staphylococcal antigens of the invention are listed on pages 33-46 of reference 51.

First Antigen Group clfA

The 'clfA' antigen is annotated as 'clumping factor A'. In the NCTC 8325 strain clfA is SAOUHSC_00812 and has amino acid sequence DEQ ID NO: 1 (GI:88194572). In the Newman strain it is nwmn_0756 (GI:151220968).

Useful clfA antigens can elicit an antibody (e.g. when administered to a human) that recognises SEQ ID NO: 1 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 1; and/or (b) comprising a fragment of at least 'n' consecutive amino acids of SEQ ID NO: 1, wherein 'n' is 7 or more (e.g. 8, 10, 12, 14, 16, 18, 20, 25, 30, 35, 40, 50, 60, 70, 80, 90, 100, 150, 200, 250 or more). These clfA proteins include variants of SEQ ID NO: 1. Preferred fragments of (b) comprise an epitope from SEQ ID NO: 1. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 1 while retaining at least one epitope of SEQ ID NO: 1. The final 368 C-terminal amino acids of SEQ ID NO: 1 can usefully be omitted. The first 39 N-terminal amino acids of SEQ ID NO: 1 can usefully be omitted. Other fragments omit one or more protein domains.

SEQ ID NO: 224 is a useful fragment of SEQ ID NO: 1 ('ClfA-$_{40-559}$'). This fragments omits the long repetitive region towards the C-terminal of SEQ ID NO: 1.

clfB

The 'clfB' antigen is annotated as 'clumping factor B'. In the NCTC 8325 strain clfB is SAOUHSC_02963 and has amino acid sequence SEQ ID NO: 2 (GI:88196585). In the Newman strain it is nwmn_2529 (GI:151222741).

Useful clfB antigens can elicit an antibody (e.g. when administered to a human) that recognises SEQ ID NO: 2 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 2; and/or (b) comprising a fragment of at least 'n' consecutive amino acids of SEQ ID NO: 2, wherein 'n' is 7 or more (e.g. 8, 10, 12, 14, 16, 18, 20, 25, 30, 35, 40, 50, 60, 70, 80, 90, 100, 150, 200, 250 or more). These clfB proteins include variants of SEQ ID NO: 2. Preferred fragments of (b) comprise an epitope from SEQ ID NO: 2. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 2 while retaining at least one epitope of SEQ ID NO: 2. The final 40 C-terminal amino acids of SEQ ID NO: 2 can usefully be omitted. The first 44 N-terminal amino acids of SEQ ID NO: 2 can usefully be omitted. Other fragments omit one or more protein domains. ClfB is naturally a long protein and so the use of fragments is helpful e.g. for purification, handling, fusion, expression, etc.

SEQ ID NO: 163 is a useful fragment of SEQ ID NO: 2 ('ClfB$_{45-552}$'). This fragment includes the most exposed domain of ClfB and is more easily used at an industrial scale. It also reduces the antigen's similarity with human proteins. Other useful fragments, based on a 3-domain model of ClfB, include: ClfB$_{45-360}$ (also known as CLfB-N12; SEQ ID NO: 196); ClfB$_{212-542}$ (also known as CLfB-N23; SEQ ID NO: 197); and ClfB$_{360-542}$ (also known as CLfB-N3; SEQ ID NO: 198).

coA

The 'coA' antigen is annotated as 'coagulase Coa'. In the NCTC 8325 strain coA is SAOUHSC_00192 and has amino acid sequence SEQ ID NO: 3 (GI:88194002). In the Newman strain it is nwmn_0166 (GI:151220378).

Useful coA antigens can elicit an antibody (e.g. when administered to a human) that recognises SEQ ID NO: 3 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 3; and/or (b) comprising a fragment of at least 'n' consecutive amino acids of SEQ ID NO: 3, wherein 'n' is 7 or more (e.g. 8, 10, 12, 14, 16, 18, 20, 25, 30, 35, 40, 50, 60, 70, 80, 90, 100, 150, 200, 250 or more). These coA proteins include variants of SEQ ID NO: 3. Preferred fragments of (b) comprise an epitope from SEQ ID NO: 3. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 3 while retaining at least one epitope of SEQ ID NO: 3. The first 14 N-terminal amino acids of SEQ ID NO: 3 can usefully be omitted. Other fragments omit one or more protein domains.

eap

The 'eap' antigen is annotated as 'MHC class II analog protein'. In the NCTC 8325 strain eap is SAOUHSC_02161 and has amino acid sequence SEQ ID NO: 4 (GI:88195840). In the Newman strain it is nwmn_1872 (GI:151222084).

Useful eap antigens can elicit an antibody (e.g. when administered to a human) that recognises SEQ ID NO: 4 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 4; and/or (b) comprising a fragment of at least 'n' consecutive amino acids of SEQ ID NO: 4, wherein 'n' is 7 or more (e.g. 8, 10, 12, 14, 16, 18, 20, 25, 30, 35, 40, 50, 60, 70, 80, 90, 100, 150, 200, 250 or more). These eap proteins include variants of SEQ ID NO: 4. Preferred fragments of (b) comprise an epitope from SEQ ID NO: 4. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 4 while retaining at least one epitope of SEQ ID NO: 4. The first 17 N-terminal amino acids of SEQ ID NO: 4 can usefully be omitted. Other fragments omit one or more protein domains.

ebhA

The 'ebhA' antigen is annotated as 'EbhA'. In the NCTC 8325 strain ebhA is SAOUHSC_01447 and has amino acid sequence SEQ ID NO: 5 (GI:88195168).

Useful ebhA antigens can elicit an antibody (e.g. when administered to a human) that recognises SEQ ID NO: 5 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 5; and/or (b) comprising a fragment of at least 'n' consecutive amino acids of SEQ ID NO: 5, wherein 'n' is 7 or more (e.g. 8, 10, 12, 14, 16, 18, 20, 25, 30, 35, 40, 50, 60, 70, 80, 90, 100, 150, 200, 250 or more). These ebhA proteins include variants of SEQ ID NO: 5. Preferred fragments of (b) comprise an epitope from SEQ ID NO: 5. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 5 while retaining at least one epitope of SEQ ID NO: 5. The first 39 N-terminal amino acids of SEQ ID NO: 5 can usefully be omitted. Other fragments omit one or more protein domains.

ebpS

The 'ebpS' antigen is annotated as 'elastin binding protein EbpS'. In the NCTC 8325 strain ebpS is SAOUHSC_01501 and has amino acid sequence SEQ ID NO: 6 (GI:88195217). In the Newman strain it is nwmn_1389 (GI:151221601).

Useful ebpS antigens can elicit an antibody (e.g. when administered to a human) that recognises SEQ ID NO: 6 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 6; and/or (b) comprising a fragment of at least 'n' consecutive amino acids of SEQ ID NO: 6, wherein 'n' is 7 or more (e.g. 8, 10, 12, 14, 16, 18, 20, 25, 30, 35, 40, 50, 60, 70, 80, 90, 100, 150, 200, 250 or more). These ebpS proteins include variants of SEQ ID NO: 6. Preferred fragments of (b) comprise an epitope from SEQ ID NO: 6. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 6 while retaining at least one epitope of SEQ ID NO: 6. Other fragments omit one or more protein domains.

SEQ ID NO: 165 is a useful fragment of SEQ ID NO: 6 ('EbpS$_{1-198}$'). This fragment includes the most exposed domain of EbpS and is more easily used at an industrial scale. It also reduces the antigen's similarity with human proteins.

efb

The 'efb' antigen is annotated as 'fibrinogen-binding protein truncated'. In the NCTC 8325 strain efb is SAOUHSC_01114 and has amino acid sequence SEQ ID NO: 7 (GI:88194860). In the Newman strain it is nwmn_1069 (GI:151221281).

Useful efb antigens can elicit an antibody (e.g. when administered to a human) that recognises SEQ ID NO: 7 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 7; and/or (b) comprising a fragment of at least 'n' consecutive amino acids of SEQ ID NO: 7, wherein 'n' is 7 or more (e.g. 8, 10, 12, 14, 16, 18, 20, 25, 30, 35, 40, 50, 60, 70, 80, 90, 100, 150 or more). These efb proteins include variants of SEQ ID NO: 7. Preferred fragments of (b) comprise an epitope from SEQ ID NO: 7. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 7 while retaining at least one epitope of SEQ ID NO: 7. The first 14 N-terminal amino acids of SEQ ID NO: 7 can usefully be omitted. Other fragments omit one or more protein domains.

emp

The 'emp' antigen is annotated as 'extracellular matrix and plasma binding protein'. In the NCTC 8325 strain emp is SAOUHSC_00816 and has amino acid sequence SEQ ID NO: 8 (GI:88194575). In the Newman strain it is nwmn_0758 (GI:151220970).

Useful emp antigens can elicit an antibody (e.g. when administered to a human) that recognises SEQ ID NO: 8 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 8; and/or (b) comprising a fragment of at least 'n' consecutive, amino acids of SEQ ID NO: 8, wherein 'n' is 7 or more (e.g. 8, 10, 12, 14, 16, 18, 20, 25, 30, 35, 40, 50, 60, 70, 80, 90, 100, 150, 200, 250 or more). These emp proteins include variants of SEQ ID NO: 8. Preferred fragments of (b) comprise an epitope from SEQ ID NO: 8. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 8 while retaining at least one epitope of SEQ ID NO: 8. The first 26 N-terminal amino acids of SEQ ID NO: 8 can usefully be omitted. Other fragments omit one or more protein domains.

SEQ ID NOs: 190, 191, 192 and 193 are useful fragments of SEQ ID NO: 8 ('Emp$_{35-340}$', 'Emp$_{27-334}$', 'Emp$_{35-334}$' and 'Emp$_{27-147}$', respectively).

esaC

The 'esaC' antigen is annotated as 'esaC'. In the NCTC 8325 strain esaC is SAOUHSC_00264 and has amino acid sequence SEQ ID NO: 9 (GI:88194069).

Useful esaC antigens can elicit an antibody (e.g. when administered to a human) that recognises SEQ ID NO: 9 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 9; and/or (b) comprising a fragment of at least 'n' consecutive amino acids of SEQ ID NO: 9, wherein 'n' is 7 or more (e.g. 8, 10, 12, 14, 16, 18, 20, 25, 30, 35, 40, 50, 60, 70, 80, 90, 100 or more). These esaC proteins include variants of SEQ ID NO: 9. Preferred fragments of (b) comprise an epitope from SEQ ID NO: 9. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 9 while retaining at least one epitope of SEQ ID NO: 9. Other fragments omit one or more protein domains.

esxA

The 'esxA' antigen is annotated as 'protein'. In the NCTC 8325 strain esxA is SAOUHSC_00257 and has amino acid sequence SEQ ID NO: 10 (GI:88194063).

Useful esxA antigens can elicit an antibody (e.g. when administered to a human) that recognises SEQ ID NO: 10 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 10; and/or (b) comprising a fragment of at least 'n' consecutive amino acids of SEQ ID NO: 10, wherein 'n' is 7 or more (e.g. 8, 10, 12, 14, 16, 18, 20, 25, 30, 35, 40, 50, 60, 70, 80, 90 or more). These esxA proteins include variants of SEQ ID NO: 10. Preferred fragments of (b) comprise an epitope from SEQ ID NO: 10. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 10 while retaining at least one epitope of SEQ ID NO: 10. Other fragments omit one or more protein domains.

esxB

The 'esxB' antigen is annotated as 'esxB'. In the NCTC 8325 strain esxB is SAOUHSC_00265 and has amino acid sequence SEQ ID NO: 11 (GI:88194070).

Useful esxB antigens can elicit an antibody (e.g. when administered to a human) that recognises SEQ ID NO: 11 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 11; and/or (b) comprising a fragment of at least 'n' consecutive amino acids of SEQ ID NO: 11, wherein 'n' is 7 or more (e.g. 8, 10, 12, 14, 16, 18, 20, 25, 30, 35, 40, 50, 60, 70, 80, 90, 100 or more). These esxB proteins include variants of SEQ ID NO: 11. Preferred fragments of (b) comprise an epitope from SEQ ID NO: 11. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 11 while retaining at least one epitope of SEQ ID NO: 11. Other fragments omit one or more protein domains.

FnBA

The 'FnBA' antigen is annotated as 'fibronectin-binding protein A precursor FnBPA'. In the NCTC 8325 strain FnBA is SAOUHSC_02803 and has amino acid sequence SEQ ID NO: 12 (GI:88196438). In the Newman strain it is nwmn_2399 (GI:151222611). Proteomic analysis has revealed that this protein is secreted or surface-exposed.

Useful FnBA antigens can elicit an antibody (e.g. when administered to a human) that recognises SEQ ID NO: 12 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 12; and/or (b) comprising a fragment of at least 'n' consecutive amino acids of SEQ ID NO: 12, wherein 'n' is 7 or more (e.g. 8, 10, 12, 14, 16, 18, 20, 25, 30, 35, 40, 50, 60, 70, 80, 90, 100, 150, 200, 250 or more). These FnBA proteins include variants of SEQ ID NO: 12. Preferred fragments of (b) comprise an epitope from SEQ ID NO: 12. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 12 while retaining at least one epitope of SEQ ID NO: 12. The final 37 C-terminal amino acids of SEQ ID NO: 12 can usefully be omitted. Other fragments omit one or more protein domains. FnBA is naturally a long protein and so the use of fragments is helpful e.g. for purification, handling, fusion, expression, etc.

SEQ ID NOs: 166 ('FnBA$_{1-511}$') and 167 ('FnBA$_{512-953}$') are useful fragments of SEQ ID NO: 12. These fragments are more easily used at an industrial scale.

FnBB

The 'FnBB' antigen is annotated as 'fibronectin binding protein B FnBPB'. In the NCTC 8325 strain FnBB is SAOUHSC_02802 and has amino acid sequence SEQ ID NO: 13 (GI:88196437). In the Newman strain it is nwmn_2397 (GI:151222609).

Useful FnBB antigens can elicit an antibody (e.g. when administered to a human) that recognises SEQ ID NO: 13 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 13; and/or (b) comprising a fragment of at least 'n' consecutive amino acids of SEQ ID NO: 13, wherein 'n' is 7 or more (e.g. 8, 10, 12, 14, 16, 18, 20, 25, 30, 35, 40, 50, 60, 70, 80, 90, 100, 150, 200, 250 or more). These FnBB proteins include variants of SEQ ID NO: 13. Preferred fragments of (b) comprise an epitope from SEQ ID NO: 13. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 13 while retaining at least one epitope of SEQ ID NO: 13. The final 37 C-terminal amino acids of SEQ ID NO: 13 can usefully be omitted. Other fragments omit one or more protein domains.

Hla

The 'Hla' antigen is the 'alpha-hemolysin precursor' also known as 'alpha toxin' or simply 'hemolysin'. In the NCTC 8325 strain Hla is SAOUHSC_01121 and has amino acid sequence SEQ ID NO: 14 (GI:88194865). In the Newman strain it is nwmn_1073 (GI:151221285). Hla is an important virulence determinant produced by most strains of S. aureus, having pore-forming and haemolytic activity. Anti-Hla antibodies can neutralise the detrimental effects of the toxin in animal models, and Hla is particularly useful for protecting against pneumonia.

Useful Hla antigens can elicit an antibody (e.g. when administered to a human) that recognises SEQ ID NO: 14 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 14; and/or (b) comprising a fragment of at least 'n' consecutive amino acids of SEQ ID NO: 14, wherein 'n' is 7 or more (e.g. 8, 10, 12, 14, 16, 18, 20, 25, 30, 35, 40, 50, 60, 70, 80, 90, 100, 150, 200, 250 or more). These Hla proteins include variants of SEQ ID NO: 14. Preferred fragments of (b) comprise an epitope from SEQ ID NO: 14. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 14 while retaining at least one epitope of SEQ ID NO: 14. The first 26 N-terminal amino acids of SEQ ID NO: 14 can usefully be omitted (e.g. to give SEQ ID NO: 231). Truncation at the C-terminus can also be used e.g. leaving only 50 amino acids (residues 27-76 of SEQ ID NO: 14) [52]. Other fragments omit one or more protein domains.

Hla's toxicity can be avoided in compositions of the invention by chemical inactivation (e.g. using formaldehyde, glutaraldehyde or other cross-linking reagents). Instead, however, it is preferred to use mutant forms of Hla which remove its toxic activity while retaining its immunogenicity. Such detoxified mutants are already known in the art. One useful Hla antigen has a mutation at residue 61 of SEQ ID NO: 14, which is residue 35 of the mature antigen (i.e. after omitting the first 26 N-terminal amino acids=residue 35 of SEQ ID NO: 231). Thus residue 61 may not be histidine, and may instead be e.g. Ile, Val or preferably Leu. A His-Arg mutation at this position can also be used. For example, SEQ ID NO: 150 is the mature mutant Hla-H35L sequence (i.e. SEQ ID NO: 231 with a H35L mutation) and a useful Hla antigen comprises SEQ ID NO: 150. Another useful mutation replaces a long loop with a short sequence e.g. to replace the 39 mer at residues 136-174 of SEQ ID NO: 14 with a tetramer such as PSGS (SEQ ID NO: 225), as in SEQ ID NO: 189 (which also includes the H35L mutation) and SEQ ID NO: 216 (which does not include the H35L mutation). Another useful mutation replaces residue Y101 e.g. with a leucine (SEQ ID NO: 242). Another useful mutation replaces residue D152 e.g. with a leucine (SEQ ID NO: 243). Another useful mutant replaces residues H35 and Y101 e.g. with a leucine (SEQ ID NO: 244). Another useful mutant replaces residues H35 and D152 e.g. with a leucine (SEQ ID NO: 245).

Further useful Hla antigens are disclosed in references 53 and 54.

SEQ ID NOs: 160, 161 & 194 are three useful fragments of SEQ ID NO: 14 ('Hla$_{27-76}$', 'Hla$_{27-89}$' and 'Hla$_{27-79}$', respectively). SEQ ID NOs: 158, 159 and 195 are the corresponding fragments from SEQ ID NO: 150.

One useful Hla sequence is SEQ ID NO: 232, which was used in the examples. It has a N-terminal Met, then an Ala-Ser dipeptide from the expression vector, then SEQ ID NO: 150 (from NCTC8325 strain). It is encoded by SEQ ID NO: 233.

hlgB

The 'hlgB' antigen is annotated as leukocidin f subunit precursor HlgB'. In the NCTC 8325 strain hlgB is SAOU-HSC_02710 and has amino acid sequence SEQ ID NO: 15 (GI:88196350).

Useful hlgB antigens can elicit an antibody (e.g. when administered to a human) that recognises SEQ ID NO: 15 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 15; and/or (b) comprising a fragment of at least 'n' consecutive amino acids of SEQ ID NO: 15, wherein 'n' is 7 or more (e.g. 8, 10, 12, 14, 16, 18, 20, 25, 30, 35, 40, 50, 60, 70, 80, 90, 100, 150, 200, 250 or more). These hlgB proteins include variants of SEQ ID NO: 15. Preferred fragments of (b) comprise an epitope from SEQ ID NO: 15. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 15 while retaining at least one epitope of SEQ ID NO: 15. The first 26 N-terminal amino acids of SEQ ID NO: 15 can usefully be omitted. Other fragments omit one or more protein domains.

hlgC

The 'hlgC' antigen is annotated as 'leukocidin s subunit precursor HlgC'. In the NCTC 8325 strain hlgC is SAOU-HSC_02709 and has amino acid sequence SEQ ID NO: 16 (GI:88196349).

Useful hlgC antigens can elicit an antibody (e.g. when administered to a human) that recognises SEQ ID NO: 16 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 16; and/or (b) comprising a fragment of at least 'n' consecutive amino acids of SEQ ID NO: 16, wherein 'n' is 7 or more (e.g. 8, 10, 12, 14, 16, 18, 20, 25, 30, 35, 40, 50, 60, 70, 80, 90, 100, 150, 200, 250 or more). These hlgC proteins include variants of SEQ ID NO: 16. Preferred fragments of (b) comprise an epitope from SEQ ID NO: 16. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 16 while retaining at least one epitope of SEQ ID NO: 16. The first 29 N-terminal amino acids of SEQ ID NO: 16 can usefully be omitted. Other fragments omit one or more protein domains.

isdA

The 'isdA' antigen is annotated as 'IsdA protein'. In the NCTC 8325 strain isdA is SAOUHSC_01081 and has amino acid sequence SEQ ID NO: 17 (GI:88194829). In the Newman strain it is nwmn_1041 (GI:151221253).

Useful isdA antigens can elicit an antibody (e.g. when administered to a human) that recognises SEQ ID NO: 17 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 17; and/or (b) comprising a fragment of at least 'n' consecutive amino acids of SEQ ID NO: 17, wherein 'n' is 7 or more (e.g. 8, 10, 12, 14, 16, 18, 20, 25, 30, 35, 40, 50, 60, 70, 80, 90, 100, 150, 200, 250 or more). These isdA proteins include variants of SEQ ID NO: 17. Preferred fragments of (b) comprise an epitope from SEQ ID NO: 17. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 17 while retaining at least one epitope of SEQ ID NO: 17. The final 38 C-terminal amino acids of SEQ ID NO: 17 can usefully be omitted. The first 46 N-terminal amino acids of SEQ ID NO: 17 can usefully be omitted. Truncation to exclude the C-terminal 38mer of SEQ ID NO: 17 (beginning with the LPKTG motif) is also useful. Other fragments omit one or more protein domains.

SEQ ID NO: 157 is a useful fragment of SEQ ID NO: 17 (amino acids 40-184 of SEQ ID NO: 17; 'IsdA$_{40-184}$') which includes the natural protein's heme binding site and includes the antigen's most exposed domain. It also reduces the antigen's similarity with human proteins. Other useful fragments are disclosed in references 55 and 56.

IsdA does not adsorb well to aluminium hydroxide adjuvants, so IsdA present in a composition may me unadsorbed or may be adsorbed to an alternative adjuvant e.g. to an aluminium phosphate.

Anti-IsdA antibodies protect mice against *S. aureus* abscess formation and lethal challenge [57].

isdB

The 'isdB' antigen is annotated as 'neurofilament protein isdB'. In the NCTC 8325 strain isdB is SAOUHSC_01079 and has amino acid sequence SEQ ID NO: 18 (GI:88194828). IsdB has been proposed for use as a vaccine antigen on its own [2], but this may not prevent pneumonia.

Useful isdB antigens can elicit an antibody (e.g. when administered to a human) that recognises SEQ ID NO: 18 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 18; and/or (b) comprising a fragment of at least 'n' consecutive amino acids of SEQ ID NO: 18, wherein 'n' is 7 or more (e.g. 8, 10, 12, 14, 16, 18, 20, 25, 30, 35, 40, 50, 60, 70, 80, 90, 100, 150, 200, 250 or more). These isdB proteins include variants of SEQ ID NO: 18. Preferred fragments of (b) comprise an epitope from SEQ ID NO: 18. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 18 while retaining at least one epitope of SEQ ID NO: 18. The final 36 C-terminal amino acids of SEQ ID NO: 18 can usefully be omitted. The first 40 N-terminal amino acids of SEQ ID NO: 18 can usefully be omitted. Other fragments omit one or more protein domains. Useful fragments of IsdB are disclosed in references 56 and 58 e.g. lacking 37 internal amino acids of SEQ ID 18.

Anti-IsdB antibodies protect mice against *S. aureus* abscess formation and lethal challenge [57].

In some embodiments, compositions of the invention do not include an isdB antigen.

isdC

The 'isdC' antigen is annotated as 'protein'. In the NCTC 8325 strain isdC is SAOUHSC_01082 and has amino acid sequence SEQ ID NO: 19 (01:88194830).

Useful isdC antigens can elicit an antibody (e.g. when administered to a human) that recognises SEQ ID NO: 19 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 19; and/or (b) comprising a fragment of at least 'n' consecutive amino acids of SEQ ID NO: 19, wherein 'n' is 7 or more (e.g. 8, 10, 12, 14, 16, 18, 20, 25, 30, 35, 40, 50, 60, 70, 80, 90, 100, 150, 200 or more). These isdC proteins include variants of SEQ ID NO: 19. Preferred fragments of (b) comprise an epitope from SEQ ID NO: 19. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 19 while retaining at least one epitope of SEQ ID NO: 19. The final 39 C-terminal amino acids of SEQ ID NO: 19 can usefully be omitted. The first 28 N-terminal amino acids of SEQ ID NO: 19 can usefully be omitted. Other fragments omit one or more protein domains. Useful fragments of IsdB are disclosed in reference 56.

Reference 59 discloses antigens which usefully include epitopes from both IsdB and IsdH.

isdG

The 'isdG' antigen is annotated as 'heme-degrading monooxygenase IsdG'. In the NCTC 8325 strain isdG is SAOUHSC_01089 and has amino acid sequence SEQ ID NO: 20 (GI:88194836).

Useful isdG antigens can elicit an antibody (e.g. when administered to a human) that recognises SEQ ID NO: 20 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 20; and/or (b) comprising a fragment of at least 'n' consecutive amino acids of SEQ ID NO: 20, wherein 'n' is 7 or more (e.g. 8, 10, 12, 14, 16, 18, 20, 25, 30, 35, 40, 50, 60, 70, 80, 90, 100 or more). These isdG proteins include variants of SEQ ID NO: 20. Preferred fragments of (b) comprise an epitope from SEQ ID NO: 20. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 20 while retaining at least one epitope of SEQ ID NO: 20. Other fragments omit one or more protein domains.

isdH

The 'isdH' antigen is annotated as 'isdH'. In the NCTC 8325 strain isdH is SAOUHSC_01843 and has amino acid sequence SEQ ID NO: 21 (GI:88195542). In the Newman strain it is nwmn_1624 (GI:151221836). It has also been known as HarA.

Useful isdH antigens can elicit an antibody (e.g. when administered to a human) that recognises SEQ ID NO: 21 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 21; and/or (b) comprising a fragment of at least 'n' consecutive amino acids of SEQ ID NO: 21, wherein 'n' is 7 or more (e.g. 8, 10, 12, 14, 16, 18, 20, 25, 30, 35, 40, 50, 60, 70, 80, 90, 100, 150, 200, 250 or more). These isdH proteins include variants of SEQ ID NO: 21. Preferred fragments of (b) comprise an epitope from SEQ ID NO: 21. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 21 while retaining at least one epitope of SEQ ID NO: 21. The final 35 C-terminal amino acids of SEQ ID NO: 21 can usefully be omitted. The first 40 N-terminal amino acids of SEQ ID NO: 21 can usefully be omitted. Other fragments omit one or more protein domains.

Reference 59 discloses antigens which usefully include epitopes from both IsdB and IsdH.

isdI

The 'isdI' antigen is annotated as 'heme-degrading monooxygenase Isd'. In the NCTC 8325 strain isdI is SAOUHSC00130 and has amino acid sequence SEQ ID NO: 22 (GI:88193943).

Useful isdI antigens can elicit an antibody (e.g. when administered to a human) that recognises SEQ ID NO: 22 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 22; and/or (b) comprising a fragment of at least 'n' consecutive amino acids of SEQ ID NO: 22, wherein 'n' is 7 or more (e.g. 8, 10, 12, 14, 16, 18, 20, 25, 30, 35, 40, 50, 60, 70, 80, 90, 100 or more). These isdI proteins include variants of SEQ ID NO: 22. Preferred fragments of (b) comprise an epitope from SEQ ID NO: 22. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 22 while retaining at least one epitope of SEQ ID NO: 22. Other fragments omit one or more protein domains.

lukD

The 'lukD' antigen is annotated as 'leukotoxin LukD'. In the NCTC 8325 strain lukD is SAOUHSC_01954 and has amino acid sequence SEQ ID NO: 23 (GI:88195647). In the Newman strain it is nwmn_1718 (GI:151221930).

Useful lukD antigens can elicit an antibody (e.g. when administered to a human) that recognises SEQ ID NO: 23 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 23; and/or (b) comprising a fragment of at least 'n' consecutive amino acids of SEQ ID NO: 23, wherein 'n' is 7 or more (e.g. 8, 10, 12, 14, 16, 18, 20, 25, 30, 35, 40, 50, 60, 70, 80, 90, 100, 150, 200, 250 or more). These lukD proteins include variants of SEQ ID NO: 23. Preferred fragments of (b) comprise an epitope from SEQ ID NO: 23. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 23 while retaining at least one epitope of SEQ ID NO: 23. The final 43 C-terminal amino acids of SEQ ID NO: 23 can usefully be omitted. The first 26 N-terminal amino acids of SEQ ID NO: 23 can usefully be omitted. Other fragments omit one or more protein domains.

lukE

The 'lukE' antigen is annotated as 'leukotoxin LukE'. In the NCTC 8325 strain lukE is SAOUHSC_01955 and has amino acid sequence SEQ ID NO: 24 (GI:88195648).

Useful lukE antigens can elicit an antibody (e.g. when administered to a human) that recognises SEQ ID NO: 24 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 24; and/or (b) comprising a fragment of at least 'n' consecutive amino acids of SEQ ID NO: 24, wherein 'n' is 7 or more (e.g. 8, 10, 12, 14, 16, 18, 20, 25, 30, 35, 40, 50, 60, 70, 80, 90, 100, 150, 200, 250 or more). These lukE proteins include variants of SEQ ID NO: 24. Preferred fragments of (b) comprise an epitope from SEQ ID NO: 24. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 24 while retaining at least one epitope of SEQ ID NO: 24. Other fragments omit one or more protein domains.

lukF

The 'lukF' antigen is annotated as 'Leukocidin/Hemolysin toxin family LukF'. In the NCTC 8325 strain lukF is SAOUHSC_02241 and has amino acid sequence SEQ ID NO: 25 (GI:88195914).

Useful lukF antigens can elicit an antibody (e.g. when administered to a human) that recognises SEQ ID NO: 25 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5%, or more) to SEQ ID NO: 25; and/or (b) comprising a fragment of at least 'n' consecutive amino acids of SEQ ID NO: 25, wherein 'n' is 7 or more (e.g. 8, 10, 12, 14, 16, 18, 20, 25, 30, 35, 40, 50, 60, 70, 80, 90, 100, 150, 200, 250 or more). These lukF proteins include variants of SEQ ID NO: 25. Preferred fragments of (b) comprise an epitope from SEQ ID NO: 25. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 25 while retaining at least one epitope of SEQ ID NO: 25. Other fragments omit one or more protein domains.

lukS

The 'lukS' antigen is annotated as 'probable leukocidin S subunit LukS'. In the NCTC 8325 strain lukS is SAOUHSC_02243 and has amino acid sequence SEQ ID NO: 26 (GI: 88195915). In the Newman strain it is nwmn_1928 (GI: 151222140).

Useful lukS antigens can elicit an antibody (e.g. when administered to a human) that recognises SEQ ID NO: 26 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 26; and/or (b) comprising a fragment of at least 'n' consecutive amino acids of SEQ ID NO: 26, wherein 'n' is 7 or more (e.g. 8, 10, 12, 14, 16, 18, 20, 25, 30, 35, 40, 50, 60, 70, 80, 90, 100, 150, 200, 250 or more). These lukS proteins include variants of SEQ ID NO: 26. Preferred fragments of (b) comprise an epitope from SEQ ID NO: 26. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 26 while retaining at least one epitope of SEQ ID NO: 26. The first 22 N-terminal amino acids of SEQ ID NO: 26 can usefully be omitted. Other fragments omit one or more protein domains.

nuc

The 'nuc' antigen is annotated as 'thermonuclease precursor'. In the NCTC 8325 strain nuc is SAOUHSC_01316 and has amino acid sequence SEQ ID NO: 27 (GI:88195046).

Useful nuc antigens can elicit an antibody (e.g. when administered to a human) that recognises SEQ ID NO: 27 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 27; and/or (b) comprising a fragment of at least 'n' consecutive amino acids of SEQ ID NO: 27, wherein 'n' is 7 or more (e.g. 8, 10, 12, 14, 16, 18, 20, 25, 30, 35, 40, 50, 60, 70, 80, 90, 100, 150 or more). These nuc proteins include variants of SEQ ID NO: 27. Preferred fragments of (b) comprise an epitope from SEQ ID NO: 27. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 27 while retaining at least one epitope of SEQ ID NO: 27. The final 39 C-terminal amino acids of SEQ ID NO: 27 can usefully be omitted. The first 19 N-terminal amino acids of SEQ ID NO: 27 can usefully be omitted. Other fragments omit one or more protein domains.

sasA

The 'sasA' antigen is annotated as 'SasA'. In the NCTC 8325 strain sasA is SAOUHSC_02990 and has amino acid sequence SEQ ID NO: 28 (GI:88196609).

Useful sasA antigens can elicit an antibody (e.g. when administered to a human) that recognises SEQ ID NO: 28 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 28; and/or (b) comprising a fragment of at least 'n' consecutive amino acids of SEQ ID NO: 28, wherein 'n' is 7 or more (e.g. 8, 10, 12, 14, 16, 18, 20, 25, 30, 35, 40, 50, 60, 70, 80, 90, 100, 150, 200, 250 or more). These sasA proteins include variants of SEQ ID NO: 28. Preferred fragments of (b) comprise an epitope from SEQ ID NO: 28. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 28 while retaining at least one epitope of SEQ ID NO: 28. The final 43 C-terminal amino acids of SEQ ID NO: 28 can usefully be omitted. The first 90 N-terminal amino acids of SEQ ID NO: 28 can usefully be omitted. Other fragments omit one or more protein domains.

sasB

The 'sasB' antigen is annotated as 'fmtB protein; SasB'. In the NCTC 8325 strain sasB is SAOUHSC_02404 and has amino acid sequence SEQ ID NO: 29 (GI:88196065).

Useful sasB antigens can elicit an antibody (e.g. when administered to a human) that recognises SEQ ID NO: 29 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 29; and/or (b) comprising a fragment of at least 'n' consecutive amino acids of SEQ ID NO: 29, wherein 'n' is 7 or more (e.g. 8, 10, 12, 14, 16, 18, 20, 25, 30, 35, 40, 50, 60, 70, 80, 90, 100, 150, 200, 250 or more). These sasB proteins include variants of SEQ ID NO: 29. Preferred fragments of (b) comprise an epitope from SEQ ID NO: 29. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 29 while retaining at least one epitope of SEQ ID NO: 29. The final 39 C-terminal amino acids of SEQ ID NO: 29 can usefully be omitted. The first 38 N-terminal amino acids of SEQ ID NO: 29 can usefully be omitted. Other fragments omit one or more protein domains.

sasC

The 'sasC' antigen is annotated as 'Mrp protein; SasC'. In the NCTC 8325 strain sasC is SAOUHSC_01873 and has amino acid sequence SEQ ID NO: 30 (GI:88195570).

Useful sasC antigens can elicit an antibody (e.g. when administered to a human) that recognises SEQ ID NO: 30 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 30; and/or (b) comprising a fragment of at least 'n' consecutive amino acids of SEQ ID NO: 30, wherein 'n' is 7 or more (e.g. 8, 10, 12, 14, 16, 18, 20, 25, 30, 35, 40, 50, 60, 70, 80, 90, 100, 150, 200, 250 or more). These sasC proteins include variants of SEQ ID NO: 30. Preferred fragments of (b) comprise an epitope from SEQ ID NO: 30. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 30 while retaining at least one epitope of SEQ ID NO: 30. The final 36 C-terminal amino acids of SEQ ID NO: 30 can usefully be omitted. The first 37 N-terminal amino acids of SEQ ID NO: 30 can usefully be omitted. Other fragments omit one or more protein domains.

sasD

The 'sasD' antigen is annotated as 'SasD protein'. In the NCTC 8325 strain sasD is SAOUHSC_00094 and has amino acid sequence SEQ ID NO: 31 (GI:88193909).

Useful sasD antigens can elicit an antibody (e.g. when administered to a human) that recognises SEQ ID NO: 31 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 31; and/or (b) comprising a fragment of at least 'n' consecutive amino acids of SEQ ID NO: 31, wherein 'n' is 7 or more (e.g. 8, 10, 12, 14, 16, 18, 20, 25, 30, 35, 40, 50, 60, 70, 80, 90, 100, 150 or more). These sasD proteins include variants of SEQ ID NO: 31. Preferred fragments of (b) comprise an epitope from SEQ ID NO: 31. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 31 while retaining at least one epitope of SEQ ID NO: 31. The first 28 N-terminal amino acids of SEQ ID NO: 31 can usefully be omitted. Other fragments omit one or more protein domains.

sasF

The 'sasF' antigen is annotated as 'sasF protein'. In the NCTC 8325 strain sasF is SAOUHSC_02982 and has amino acid sequence SEQ ID NO: 32 (GI:88196601).

Useful sasF antigens can elicit an antibody (e.g. when administered to a human) that recognises SEQ ID NO: 32 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 32; and/or (b) comprising a fragment of at least 'n' consecutive amino acids of SEQ ID NO: 32, wherein 'n' is 7 or more (e.g. 8, 10, 12, 14, 16, 18, 20, 25, 30, 35, 40, 50, 60, 70, 80, 90, 100, 150, 200, 250 or more). These sasF proteins include variants of SEQ ID NO: 32. Preferred fragments of (b) comprise an epitope from SEQ ID NO: 32. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 32 while retaining at least one epitope of SEQ ID NO: 32. The final 39 C-terminal amino acids of SEQ ID NO: 32 can usefully be omitted. The first 37 N-terminal amino acids of SEQ ID NO: 32 can usefully be omitted. Other fragments omit one or more protein domains.

sdrC

The 'sdrC' antigen is annotated as 'sdrC protein'. In the NCTC 8325 strain sdrC is SAOUHSC_00544 and has amino acid sequence SEQ ID NO: 33 (GI:88194324).

Useful sdrC antigens can elicit an antibody (e.g. when administered to a human) that recognises SEQ ID NO: 33 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 33; and/or (b) comprising a fragment of at least 'n' consecutive amino acids of SEQ ID NO: 33, wherein 'n' is 7 or more (e.g. 8, 10, 12, 14, 16, 18, 20, 25, 30, 35, 40, 50, 60, 70, 80, 90, 100, 150, 200, 250 or more). These sdrC proteins include variants of SEQ ID NO: 33. Preferred fragments of (b) comprise an epitope from SEQ ED NO: 33. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 33 while retaining at least one epitope of SEQ ID NO: 33. The final 38 C-terminal amino acids of SEQ ID NO: 33 can usefully be omitted. The first 50 N-terminal amino acids of SEQ ID NO: 33 can usefully be omitted. Other fragments omit one or more protein domains. SdrC is naturally a long protein and so the use of fragments is helpful e.g. for purification, handling, fusion, expression, etc.

SEQ ID NO: 164 is a useful fragment of SEQ ID NO: 33 ('SdrC5$_{1-518}$'). This fragment includes the most exposed domain of SdrC and is more easily used at an industrial scale. It also reduces the antigen's similarity with human proteins.

sdrD

The 'sdrD' antigen is annotated as 'sdrD protein'. In the NCTC 8325 strain sdrD is SAOUHSC_00545 and has amino acid sequence SEQ ID NO: 34 (GI:88194325).

Useful sdrD antigens can elicit an antibody (e.g. when administered to a human) that recognises SEQ ID NO: 34 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 34; and/or (b) comprising a fragment of at least 'n' consecutive amino acids of SEQ ID NO: 34, wherein 'n' is 7 or more (e.g. 8, 10, 12, 14, 16, 18, 20, 25, 30, 35, 40, 50, 60, 70, 80, 90, 100, 150, 200, 250 or more). These sdrD proteins include variants of SEQ ID NO: 34. Preferred fragments of (b) comprise an epitope from SEQ ID NO: 34. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 34 while retaining at least one epitope of SEQ ID NO: 34. The final 38 C-terminal amino acids of SEQ ID NO: 34 can usefully be omitted. The first 52 N-terminal amino acids of SEQ ID NO: 34 can usefully be omitted. Other fragments omit one or more protein domains. SdrD is naturally a long protein and so the use of fragments is very helpful e.g. for purification, handling, fusion, expression, etc.

SEQ ID NO: 156 is a useful fragment of SEQ ID NO: 34 ('SdrD5$_{3-592}$'). This fragment includes the most exposed domain of SdrD and is more easily used at an industrial scale. It also reduces the antigen's similarity with human proteins. Another useful fragment, with the same C-terminus residue, is SdrD$_{394-592}$ (also known as SdrD-N3; SEQ ID NO: 199). Another useful fragment is SEQ ID NO: 236 (amino acids 593-1123 of SEQ ID NO: 34), referred to herein as 'SdrD$_{CnaB}$'.

sdrE2

The 'sdrE2' antigen is annotated as 'Ser-Asp rich fibrinogen/bone sialoprotein-binding protein SdrE'. In the Newman strain sdrE2 is NWMN_0525 and has amino acid sequence SEQ ID NO: 35 (GI:151220737).

Useful sdrE2 antigens can elicit an antibody (e.g. when administered to a human) that recognises SEQ ID NO: 35 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 35; and/or (b) comprising a fragment of at least 'n' consecutive amino acids of SEQ ID NO: 35, wherein 'n' is 7 or more (e.g. 8, 10, 12, 14, 16, 18, 20, 25, 30, 35, 40, 50, 60, 70, 80, 90, 100, 150, 200, 250 or more). These sdrE2 proteins include variants of SEQ ID NO: 35. Preferred fragments of (b) comprise an epitope from SEQ ID NO: 35. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 35 while retaining at least one epitope of SEQ ID NO: 35. The final 38 C-terminal amino acids of SEQ ID NO: 35 can usefully be omitted. The first 52 N-terminal amino acids of SEQ ID NO: 35 can usefully be omitted. Other fragments omit one or more protein domains. SdrE2 is naturally a long protein and so the use of fragments is very helpful e.g. for purification, handling, fusion, expression, etc.

SEQ ID NO: 155 is a useful fragment of SEQ ID NO: 35 ('SdrE$_{53-632}$'). This fragment includes the most exposed domain of SdrE2 and is more easily used at an industrial scale. It also reduces the antigen's similarity with human proteins.

spa

The 'spa' antigen is annotated as 'protein A' or 'SpA'. In the NCTC 8325 strain spa is SAOUHSC_00069 and has amino acid sequence SEQ ID NO: 36 (GI:88193885). In the Newman strain it is nwmn_0055 (GI:151220267). All *S. aureus* strains express the structural gene for spa, a well characterized virulence factor whose cell wall-anchored surface protein product has five highly homologous immunoglobulin binding domains designated E, D, A, B, and C [60]. These domains display ~80% identity at the amino acid level, are 56 to 61 residues in length, and are organized as tandem repeats [61]. SpA is synthesized as a precursor protein with an N-terminal signal peptide and a C-terminal sorting signal [62,63]. Cell wall-anchored spa is displayed in great abundance on the staphylococcal surface [64,65]. Each of its immunoglobulin binding domains is composed of anti-parallel α-helices that assemble into a three helix bundle and can bind the Fc domain of immunoglobulin G (IgG) [66,67], the VH3 heavy chain (Fab) of IgM (i.e. the B cell receptor) [68], the von Willebrand factor at its A1 domain [69] and/or the TNFα receptor I (TNFRI) [70], which is displayed on surfaces of airway epithelia.

Useful spa antigens can elicit an antibody (e.g. when administered to a human) that recognises SEQ ID NO: 36 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 36; and/or (b) comprising a fragment of at least 'n' consecutive amino acids of SEQ ID NO: 36, wherein 'n' is 7 or more (e.g. 8, 10, 12, 14, 16, 18, 20, 25, 30, 35, 40, 50, 60, 70, 80, 90, 100, 150, 200, 250 or more). These spa proteins include variants of SEQ ID NO: 36. Preferred fragments of (b) comprise an epitope from SEQ ID NO: 36. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 36 while retaining at least one epitope of SEQ ID NO: 36. The final 35 C-terminal amino acids of SEQ ID NO: 36 can usefully be omitted. The first 36 N-terminal amino acids of SEQ ID NO: 36 can usefully be omitted. Other fragments omit one or more protein domains. Reference 71 suggests that individual IgG-binding domains might be useful immunogens, alone or in combination.

SEQ ID NO: 162 is a useful fragment of SEQ ID NO: 36 ('Spa$_{37-325}$'). This fragment contains all the five SpA Ig-binding domains (which are naturally arranged from N- to C-terminus in the order E, D, A, B, C) and includes the most exposed domain of SpA. It also reduces the antigen's similarity with human proteins. Other useful fragments may omit 1, 2, 3 or 4 of the natural A, B, C, D and/or E domains to prevent the excessive B cell expansion and then apoptosis which might occur if spa functions as a B cell superantigen. As reported in reference 71, other useful fragments may include only 1, 2, 3 or 4 of the natural A, B, C, D and/or E domains e.g. comprise only the SpA(A) domain but not B to E, or comprise only the SpA(D) domain but not A, B, C or E, etc. Thus a spa antigen useful with the invention may include 1, 2, 3, 4 or 5 IgG-binding domains, but ideally has 4 or fewer If an antigen includes only one type of spa domain (e.g. only the Spa(A) or SpA(D) domain), it may include more than one copy of this domain e.g. multiple SpA(D) domains in a single polypeptide chain.

An individual domain within the antigen may be mutated at 1, 2, 3, 4, 5, 6, 7, 8, 9, 10 or more amino acids relative to SEQ ID NO: 36 (e.g. see ref. 71, disclosing mutations at residues 3 and/or 24 of domain D, at residue 46 and/or 53 of domain A, etc.). Such mutants should not remove the antigen's ability to elicit an antibody that recognises SEQ ID NO: 36, but may remove the antigen's binding to IgG and/or other human proteins (such as human blood proteins).

In certain aspects a spa antigen includes a substitution at (a) one or more amino acid substitution in an IgG Fc binding sub-domain of SpA domain A, B, C, D and/or E that disrupts or decreases binding to IgG Fc, and (b) one or more amino acid substitution in a $V_H3$ binding sub-domain of SpA domain A, B, C, D, and/or E that disrupts or decreases binding to $V_H3$. In certain embodiments, a variant SpA comprises at least or at most 1, 2, 3, 4, 5, 6, 7, 8, 9, 10 or more variant SpA domain D peptides.

Second Antigen Group sta001

The 'sta001' antigen is annotated as '5'-nucleotidase family protein'. In the NCTC 8325 strain sta001 is SAOUHSC_00025 and has amino acid sequence SEQ ID NO: 37 (GI: 88193846). In the Newman strain it is nwmn_0022 (GI: 151220234). It has also been referred to as AdsA and SasH and SA0024.

Useful sta001 antigens can elicit an antibody (e.g. when administered to a human) that recognises SEQ ID NO: 37 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 37; and/or (b) comprising a fragment of at least 'n' consecutive amino acids of SEQ ID NO: 37, wherein 'n' is 7 or more (e.g. 8, 10, 12, 14, 16, 18, 20, 25, 30, 35, 40, 50, 60, 70, 80, 90, 100, 150, 200, 250 or more). These sta001 proteins include variants of SEQ ID NO: 37. Preferred fragments of (b) comprise an epitope from SEQ ID NO: 37. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 37 while retaining at least one epitope of SEQ ID NO: 37. The final 34 C-terminal amino acids of SEQ ID NO: 37 can usefully be omitted. The first 38 N-terminal amino acids of SEQ ID NO: 37 can usefully be omitted. Other fragments omit one or more protein domains.

sta002

The 'sta002' antigen is annotated as 'lipoprotein'. In the NCTC 8325 strain sta002 is SAOUHSC_00356 and has amino acid sequence SEQ ID NO: 38 (GI:88194155). In the Newman strain it is nwmn_0364 (GI:151220576).

Useful sta002 antigens can elicit an antibody (e.g. when administered to a human) that recognises SEQ ID NO: 38 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 38; and/or (b) comprising a fragment of at least 'n' consecutive amino acids of SEQ ID NO: 38, wherein 'n' is 7 or more (e.g. 8, 10, 12, 14, 16, 18, 20, 25, 30, 35, 40, 50, 60, 70, 80, 90, 100, 150 or more). These sta002 proteins include variants of SEQ ID NO: 38. Preferred fragments of (b) comprise an epitope from SEQ ID NO: 38. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 38 while retaining at least one epitope of SEQ ID NO: 38. The first 18 N-terminal amino acids of SEQ ID NO: 38 can usefully be omitted. Other fragments omit one or more protein domains.

SEQ ID NOs: 153 ('sta002$_{19-187}$') and 154 ('sta002$_{19-124}$') are two useful frag 38 which reduce the antigen's similarity with human proteins.

sta003

The 'sta003' antigen is annotated as 'surface protein'. In the NCTC 8325 strain sta003 is SAOUHSC_00400 and has amino acid sequence SEQ ID NO: 39 (GI:88194195). In the Newman strain it is nwmn_0401 (GI:151220613).

Useful sta003 antigens can elicit an antibody (e.g. when administered to a human) that recognises SEQ ID NO: 39 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 39; and/or (b) comprising a fragment of at least 'n' consecutive amino acids of SEQ ID NO: 39, wherein 'n' is 7 or more (e.g. 8, 10, 12, 14, 16, 18, 20, 25, 30, 35, 40, 50, 60, 70, 80, 90, 100, 150, 200, 250 or more). These sta003 proteins include variants of SEQ ID NO: 39. Preferred fragments of (b) comprise an epitope from SEQ ID NO: 39. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 39 while retaining at least one epitope of SEQ ID NO: 39. The first 32 N-terminal amino acids of SEQ ID NO: 39 can usefully be omitted. Other fragments omit one or more protein domains.

sta004

The 'sta004' antigen is annotated as 'Siderophore binding protein FatB'. In the NCTC 8325 strain sta004 is SAOUHSC_00749 and has amino acid sequence SEQ ID NO: 40 (GI:88194514). In the Newman strain it is nwmn_0705 (GI:151220917).

Useful sta004 antigens can elicit an antibody (e.g. when administered to a human) that recognises SEQ ID NO: 40 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 40; and/or (b) comprising a fragment of at least 'n' consecutive amino acids of SEQ ID NO: 40, wherein 'n' is 7 or more (e.g. 8, 10, 12, 14, 16, 18, 20, 25, 30, 35, 40, 50, 60, 70, 80, 90, 100, 150, 200, 250 or more). These sta004 proteins include variants of SEQ ID NO: 40. Preferred fragments of (b) comprise an epitope from SEQ ID NO: 40. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 40 while retaining at least one epitope of SEQ ID NO: 40. The first 18 N-terminal amino acids of SEQ ID NO: 40 can usefully be omitted. Other fragments omit one or more protein domains.

sta005

The 'sta005' antigen is annotated as 'superantigen-like protein'. In the NCTC 8325 strain sta005 is SAOUHSC_01127 and has amino acid sequence SEQ ID NO: 41 (GI: 88194870). In the Newman strain it is nwmn_1077 (GI: 151221289).

Useful sta005 antigens can elicit an antibody (e.g. when administered to a human) that recognises SEQ ID NO: 41 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 41; and/or (b) comprising a fragment of at least 'n' consecutive amino acids of SEQ ID NO: 41, wherein 'n' is 7 or more (e.g. 8, 10, 12, 14, 16, 18, 20, 25, 30, 35, 40, 50, 60, 70, 80, 90, 100, 150, 200 or more). These sta005 proteins include variants of SEQ ID NO: 41. Preferred fragments of (b) comprise an epitope from SEQ ID NO: 41. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 41 while retaining at least one epitope of SEQ ID NO: 41. The first 18 N-terminal amino acids of SEQ ID NO: 41 can usefully be omitted. Other fragments omit one or more protein domains.

sta006

The 'sta006' antigen is annotated as 'ferrichrome-binding protein', and has also been referred to as 'FhuD2' in the literature [72]. In the NCTC 8325 strain sta006 is SAOUHSC_02554 and has amino acid sequence SEQ ID NO: 42 (GI:88196199). In the Newman strain it is nwmn_2185 (GI:151222397).

Useful sta006 antigens can elicit an antibody (e.g. when administered to a human) that recognises SEQ ID NO: 42 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 42; and/or (b) comprising a fragment of at least 'n' consecutive amino acids of SEQ ID NO: 42, wherein 'n' is 7 or more (e.g. 8, 10, 12, 14, 16, 18, 20, 25, 30, 35, 40, 50, 60, 70, 80, 90, 100, 150, 200, 250 or more). These sta006 proteins include variants of SEQ ID NO: 42. Preferred fragments of (b) comprise an epitope from SEQ ID NO: 42. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 42 while retaining at least one epitope of SEQ ID NO: 42. The first 17 N-terminal amino acids of SEQ ID NO: 42 can usefully be omitted (to provide SEQ ID NO: 246). Other fragments omit one or more protein domains. Mutant forms of sta006 are reported in reference 73. A sta006 antigen may be lipidated e.g. with an acylated N-terminus cysteine. One useful sta006 sequence is SEQ ID NO: 248, which has a Met-Ala-Ser-sequence at the N-terminus.

sta007

The 'sta007' antigen is annotated as 'secretory antigen precursor'. In the NCTC 8325 strain sta007 is SAOUHSC_02571 and has amino acid sequence SEQ ID NO: 43 (GI:88196215). In the Newman strain it is nwmn_2199 (GI:151222411). Proteomic analysis has revealed that this protein is secreted or surface-exposed.

Useful sta007 antigens can elicit an antibody (e.g. when administered to a human) that recognises SEQ ID NO: 43 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 43; and/or (b) comprising a fragment of at least 'n' consecutive amino acids of SEQ ID NO: 43, wherein 'n' is 7 or more (e.g. 8, 10, 12, 14, 16, 18, 20, 25, 30, 35, 40, 50, 60, 70, 80, 90, 100, 150, 200, 250 or more). These sta007 proteins include variants of SEQ ID NO: 43. Preferred fragments of (b) comprise an epitope from SEQ ID NO: 43. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 43 while retaining at least one epitope of SEQ ID NO: 43. The first 27 N-terminal amino acids of SEQ ID NO: 43 can usefully be omitted. Other fragments omit one or more protein domains.

sta008

The 'sta008' antigen is annotated as 'lipoprotein'. In the NCTC 8325 strain sta008 is SAOUHSC_02650 and has amino acid sequence SEQ ID NO: 44 (GI:88196290). In the Newman strain it is nwmn_2270 (GI:151222482).

Useful sta008 antigens can elicit an antibody (e.g. when administered to a human) that recognises SEQ ID NO: 44 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 44; and/or (b) comprising a fragment of at least 'n' consecutive amino acids of SEQ ID NO: 44, wherein 'n' is 7 or more (e.g. 8, 10, 12, 14, 16, 18, 20, 25, 30, 35, 40, 50, 60, 70, 80, 90, 100, 150, 200 or more). These sta008 proteins include variants of SEQ ID NO: 44. Preferred fragments of (b) comprise an epitope from SEQ ID NO: 44. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 44 while retaining at least one epitope of SEQ ID NO: 44. The first 17 N-terminal amino acids of SEQ ID NO: 44 can usefully be omitted. Other fragments omit one or more protein domains.

sta009

The 'sta009' antigen is annotated as 'immunoglobulin G-binding protein Sbi'. In the NCTC 8325 strain sta009 is SAOUHSC_02706 and has amino acid sequence SEQ ID NO: 45 (GI:88196346). In the Newman strain it is nwmn_2317 (GI:151222529).

Useful sta009 antigens can elicit an antibody (e.g. when administered to a human) that recognises SEQ ID NO: 45 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 45; and/or (b) comprising a fragment of at least 'n' consecutive amino acids of SEQ ID NO: 45, wherein 'n' is 7 or more (e.g. 8, 10, 12, 14, 16, 18, 20, 25, 30, 35, 40, 50, 60, 70, 80, 90, 100, 150, 200, 250 or more). These sta009 proteins include variants of SEQ ID NO: 45. Preferred fragments of (b) comprise an epitope from SEQ ID NO: 45. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 45 while retaining at least one epitope of SEQ ID NO: 45. The first 29 N-terminal amino acids of SEQ ID NO: 45 can usefully be omitted. Other fragments omit one or more protein domains.

sta010

The 'sta010' antigen is annotated as 'immunodominant antigen A'. In the NCTC 8325 strain sta010 is SAOUHSC_02887 and has amino acid sequence SEQ ID NO: 46 (GI:88196515). In the Newman strain it is nwmn_2469 (GI:151222681). Proteomic analysis has revealed that this protein is secreted or surface-exposed.

Useful sta010 antigens can elicit an antibody (e.g. when administered to a human) that recognises SEQ ID NO: 46 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 46; and/or (b) comprising a fragment of at least 'n' consecutive amino acids of SEQ ID NO: 46, wherein 'n' is 7 or more (e.g. 8, 10, 12, 14, 16, 18, 20, 25, 30, 35, 40, 50, 60, 70, 80, 90, 100, 150, 200 or more). These sta010 proteins include variants of SEQ ID NO: 46. Preferred fragments of (b) comprise an epitope from SEQ ID NO: 46.

Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 46 while retaining at least one epitope of SEQ ID NO: 46. The first 29 N-terminal amino acids of SEQ ID NO: 46 can usefully be omitted. Other fragments omit one or more protein domains.

sta011

The 'sta011' antigen is annotated as 'lipoprotein'. In the NCTC 8325 strain sta011 is SAOUHSC_00052 and has amino acid sequence SEQ ID NO: 47 (GI:88193872).

Useful sta011 antigens can elicit an antibody (e.g. when administered to a human) that recognises SEQ ID NO: 47 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 47; and/or (b) comprising a fragment of at least 'n' consecutive amino acids of SEQ ID NO: 47, wherein 'n' is 7 or more (e.g. 8, 10, 12, 14, 16, 18, 20, 25, 30, 35, 40, 50, 60, 70, 80, 90, 100, 150, 200, 250 or more). These sta011 proteins include variants of SEQ ID NO: 47. Preferred fragments of (b) comprise an epitope from SEQ ID NO: 47. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 47 while retaining at least one epitope of SEQ ID NO: 47. The first 23 N-terminal amino acids of SEQ ID NO: 47 can usefully be omitted (to provide SEQ ID NO: 247). Other fragments omit one or more protein domains. A sta011 antigen may be lipidated e.g. with an acylated N-terminus cysteine. One useful sta011 sequence is SEQ ID NO: 249, which has a N-terminus methionine.

Variant forms of SEQ ID NO: 47 which may be used as or for preparing sta011 antigens include, but are not limited to, SEQ ID NOs: 213, 214 and 215 with various Ile/Val/Leu substitutions.

Sta011 can exist as a monomer or an oligomer, with $Ca^{++}$ ions favouring oligomerisation. The invention can use monomers and/or oligomers of Sta011.

sta012

The 'sta012' antigen is annotated as 'protein with leader'. In the NCTC 8325 strain sta012 is SAOUHSC_00106 and has amino acid sequence SEQ ID NO: 48 (GI:88193919).

Useful sta012 antigens can elicit an antibody (e.g. when administered to a human) that recognises SEQ ID NO: 48 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 48; and/or (b) comprising a fragment of at least 'n' consecutive amino acids of SEQ ID NO: 48, wherein 'n' is 7 or more (e.g. 8, 10, 12, 14, 16, 18, 20, 25, 30, 35, 40, 50, 60, 70, 80, 90, 100, 150, 200, 250 or more). These sta012 proteins include variants of SEQ ID NO: 48. Preferred fragments of (b) comprise an epitope from SEQ ID NO: 48. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 48 while retaining at least one epitope of SEQ ID NO: 48. The first 21 N-terminal amino acids of SEQ ID NO: 48 can usefully be omitted. Other fragments omit one or more protein domains.

sta013

The 'sta013' antigen is annotated as 'poly-gamma-glutamate capsule biosynthesis protein'. In the NCTC 8325 strain sta013 is SAOUHSC_00107 and has amino acid sequence SEQ ID NO: 49 (GI:88193920).

Useful sta013 antigens can elicit an antibody (e.g. when administered to a human) that recognises SEQ ID NO: 49 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 49; and/or (b) comprising a fragment of at least 'n' consecutive amino acids of SEQ ID NO: 49, wherein 'n' is 7 or more (e.g. 8, 10, 12, 14, 16, 18, 20, 25, 30, 35, 40, 50, 60, 70, 80, 90, 100, 150, 200, 250 or more). These sta013 proteins include variants of SEQ ID NO: 49. Preferred fragments of (b) comprise an epitope from SEQ ID NO: 49. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 49 while retaining at least one epitope of SEQ ID NO: 49. Other fragments omit one or more protein domains.

sta014

The 'sta014' antigen is annotated as 'lipoprotein'. In the NCTC 8325 strain sta014 is SAOUHSC_00137 and has amino acid sequence SEQ ID NO: 50 (GI:88193950).

Useful sta014 antigens can elicit an antibody (e.g. when administered to a human) that recognises SEQ ID NO: 50 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 50; and/or (b) comprising a fragment of at least 'n' consecutive amino acids of SEQ ID NO: 50, wherein 'n' is 7 or more (e.g. 8, 10, 12, 14, 16, 18, 20, 25, 30, 35, 40, 50, 60, 70, 80, 90, 100, 150, 200, 250 or more). These sta014 proteins include variants of SEQ ID NO: 50. Preferred fragments of (b) comprise an epitope from SEQ ID NO: 50. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 50 while retaining at least one epitope of SEQ ID NO: 50. The first 17 N-terminal amino acids of SEQ ID NO: 50 can usefully be omitted. Other fragments omit one or more protein domains.

sta015

The 'sta015' antigen is annotated as 'extracellular solute-binding protein; RGD containing lipoprotein'. In the NCTC 8325 strain sta015 is SAOUHSC_00170 and has amino acid sequence SEQ ID NO: 51 (GI:88193980).

Useful sta015 antigens can elicit an antibody (e.g. when administered to a human) that recognises SEQ ID NO: 51 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 51; and/or (b) comprising a fragment of at least 'n' consecutive amino acids of SEQ ID NO: 51, wherein 'n' is 7 or more (e.g. 8, 10, 12, 14, 16, 18, 20, 25, 30, 35, 40, 50, 60, 70, 80, 90, 100, 150, 200, 250 or more). These sta015 proteins include variants of SEQ ID NO: 51. Preferred fragments of (b) comprise an epitope from SEQ ID NO: 51. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 51 while retaining at least one epitope of SEQ ID NO: 51. The first 18 N-terminal amino acids of SEQ ID NO: 51 can usefully be omitted. Other fragments omit one or more protein domains.

sta016

The 'sta016' antigen is annotated as 'gamma-glutamyl-transpeptidase'. In the NCTC 8325 strain sta016 is SAOUHSC_00171 and has amino acid sequence SEQ ID NO: 52 (GI:88193981).

Useful sta016 antigens can elicit an antibody (e.g. when administered to a human) that recognises SEQ ID NO: 52 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 52; and/or (b) comprising a fragment of at least 'n' consecutive amino acids of SEQ ID NO: 52, wherein 'n' is 7 or more (e.g. 8, 10, 12, 14, 16, 18, 20, 25, 30, 35, 40, 50, 60, 70, 80, 90, 100, 150, 200, 250 or more). These sta016 proteins include variants of SEQ ID NO: 52. Preferred fragments of (b) comprise an epitope from SEQ ID NO: 52. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 52 while retaining at least one epitope of SEQ ID NO: 52. Other fragments omit one or more protein domains.

sta017

The 'sta017' antigen is annotated as 'lipoprotein'. In the NCTC 8325 strain sta017 is SAOUHSC_00186 and has amino acid sequence SEQ ID NO: 53 (GI:88193996).

Useful sta017 antigens can elicit an antibody (e.g. when administered to a human) that recognises SEQ ID NO: 53 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 53; and/or (b) comprising a fragment of at least 'n' consecutive amino acids of SEQ ID NO: 53, wherein 'n' is 7 or more (e.g. 8, 10, 12, 14, 16, 18, 20, 25, 30, 35, 40, 50, 60, 70, 80, 90, 100, 150, 200, 250 or more). These sta017 proteins include variants of SEQ ID NO: 53. Preferred fragments of (b) comprise an epitope from SEQ ID NO: 53. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 53 while retaining at least one epitope of SEQ ID NO: 53. The first 17 N-terminal amino acids of SEQ ID NO: 53 can usefully be omitted. Other fragments omit one or more protein domains.

sta018

The 'sta018' antigen is annotated as 'extracellular solute-binding protein'. In the NCTC 8325 strain sta018 is SAOUHSC_00201 and has amino acid sequence SEQ ID NO: 54 (GI:88194011).

Useful sta018 antigens can elicit an antibody (e.g. when administered to a human) that recognises SEQ ID NO: 54 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 54; and/or (b) comprising a fragment of at least 'n' consecutive amino acids of SEQ ID NO: 54, wherein 'n' is 7 or more (e.g. 8, 10, 12, 14, 16, 18, 20, 25, 30, 35, 40, 50, 60, 70, 80, 90, 100, 150, 200, 250 or more). These sta018 proteins include variants of SEQ ID NO: 54. Preferred fragments of (b) comprise an epitope from SEQ ID NO: 54. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 54 while retaining at least one epitope of SEQ ID NO: 54. Other fragments omit one or more protein domains.

sta019

The 'sta019' antigen is annotated as 'peptidoglycan hydrolase'. In the NCTC 8325 strain sta019 is SAOUHSC_00248 and has amino acid sequence SEQ ID NO: 55 (GI:88194055). In the Newman strain it is nwmn_0210 (GI:151220422).

Useful sta019 antigens can elicit an antibody (e.g. when administered to a human) that recognises SEQ ID NO: 55 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 55; and/or (b) comprising a fragment of at least 'n' consecutive amino acids of SEQ ID NO: 55, wherein 'n' is 7 or more (e.g. 8, 10, 12, 14, 16, 18, 20, 25, 30, 35, 40, 50, 60, 70, 80, 90, 100, 150, 200, 250 or more). These sta019 proteins include variants of SEQ ID NO: 55. Preferred fragments of (b) comprise an epitope from SEQ ID NO: 55. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 55 while retaining at least one epitope of SEQ ID NO: 55. The first 25 N-terminal amino acids of SEQ ID NO: 55 can usefully be omitted. Other fragments omit one or more protein domains. Useful fragments are SEQ ID NOs: 228 and 229.

Sta019 does not adsorb well to aluminium hydroxide adjuvants, so Sta019 present in a composition may me unadsorbed or may be adsorbed to an alternative adjuvant e.g. to an aluminium phosphate.

sta020

The 'sta020' antigen is annotated as 'exported protein'. In the NCTC 8325 strain sta020 is SAOUHSC_00253 and has amino acid sequence SEQ ID NO: 56 (GI:88194059).

Useful sta020 antigens can elicit an antibody (e.g. when administered to a human) that recognises SEQ ID NO: 56 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 56; and/or (b) comprising a fragment of at least 'n' consecutive amino acids of SEQ ID NO: 56, wherein 'n' is 7 or more (e.g. 8, 10, 12, 14, 16, 18, 20, 25, 30, 35, 40, 50, 60, 70, 80, 90, 100, 150, 200, 250 or more). These sta020 proteins include variants of SEQ ID NO: 56. Preferred fragments of (b) comprise an epitope from SEQ ID NO: 56. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 56 while retaining at least one epitope of SEQ ID NO: 56. The first 30 N-terminal amino acids of SEQ ID NO: 56 can usefully be omitted. Other fragments omit one or more protein domains.

sta021

The 'sta021' antigen is annotated as 'secretory antigen SsaA-like protein'. In the NCTC 8325 strain sta021 is SAOUHSC_00256 and has amino acid sequence SEQ ID NO: 57 (GI:88194062).

Useful sta021 antigens can elicit an antibody (e.g. when administered to a human) that recognises SEQ ID NO: 57 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 57; and/or (b) comprising a fragment of at least 'n' consecutive amino acids of SEQ ID NO: 57, wherein 'n' is 7 or more (e.g. 8, 10, 12, 14, 16, 18, 20, 25, 30, 35, 40, 50, 60, 70, 80, 90, 100, 150, 200, 250 or more). These sta021 proteins include variants of SEQ ID NO: 57. Preferred fragments of (b) comprise an epitope from SEQ ID NO: 57. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 57 while retaining at least one epitope of SEQ ID NO: 57. The first 24 N-terminal amino acids of SEQ ID NO: 57 can usefully be omitted. Other fragments omit one or more protein domains.

sta022

The 'sta022' antigen is annotated as 'lipoprotein'. In the NCTC 8325 strain sta022 is SAOUHSC_00279 and has amino acid sequence SEQ ID NO: 58 (GI:88194083).

Useful sta022 antigens can elicit an antibody (e.g. when administered to a human) that recognises SEQ ID NO: 58 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 58; and/or (b) comprising a fragment of at least 'n' consecutive amino acids of SEQ ID NO: 58, wherein 'n' is 7 or more (e.g. 8, 10, 12, 14, 16, 18, 20, 25, 30, 35, 40, 50, 60, 70, 80, 90, 100 or more). These sta022 proteins include variants of SEQ ID NO: 58. Preferred fragments of (b) comprise an epitope from SEQ ID NO: 58. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 58 while retaining at least one epitope of SEQ ID NO: 58. The first 17 N-terminal amino acids of SEQ ID NO: 58 can usefully be omitted. Other fragments omit one or more protein domains.

sta023

The 'sta023' antigen is annotated as '5'-nucleotidase; lipoprotein e(P4) family'. In the NCTC•8325 strain sta023 is SAOUHSC_00284 and has amino acid sequence SEQ ID NO: 59 (GI:88194087).

Useful sta023 antigens can elicit an antibody (e.g. when administered to a human) that recognises SEQ ID NO: 59 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 59; and/or (b) comprising a fragment of at least 'n' consecutive amino acids of SEQ ID NO: 59, wherein 'n' is 7 or more (e.g. 8, 10, 12, 14, 16, 18, 20, 25, 30, 35, 40, 50, 60, 70, 80, 90, 100, 150, 200, 250 or more). These sta023 proteins include variants of SEQ ID NO: 59. Preferred fragments of (b) comprise an epitope from SEQ ID NO: 59. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 59 while retaining at least one epitope of SEQ ID NO: 59. The first 31 N-terminal amino acids of SEQ ID NO: 59 can usefully be omitted. Other fragments omit one or more protein domains.

sta024

The 'sta024' antigen is annotated as 'lipase precursor'. In the NCTC 8325 strain sta024 is SAOUHSC_00300 and has amino acid sequence SEQ ID NO: 60 (GI:88194101).

Useful sta024 antigens can elicit an antibody (e.g. when administered to a human) that recognises SEQ ID NO: 60 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 60; and/or (b) comprising a fragment of at least 'n' consecutive amino acids of SEQ ID NO: 60, wherein 'n' is 7 or more (e.g. 8, 10, 12, 14, 16, 18, 20, 25, 30, 35, 40, 50, 60, 70, 80, 90, 100, 150, 200, 250 or more). These sta024 proteins include variants of SEQ ID NO: 60. Preferred fragments of (b) comprise an epitope from SEQ ID NO: 60. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 60 while retaining at least one epitope of SEQ ID NO: 60. The first 37 N-terminal amino acids of SEQ ID NO: 60 can usefully be omitted. Other fragments omit one or more protein domains.

sta025

The 'sta025' antigen is annotated as 'lipoprotein'. In the NCTC 8325 strain sta025 is SAOUHSC_00362 and has amino acid sequence SEQ ID NO: 61 (GI:88194160).

Useful sta025 antigens can elicit an antibody (e.g. when administered to a human) that recognises SEQ ID NO: 61 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 61; and/or (b) comprising a fragment of at least 'n' consecutive amino acids of SEQ ID NO: 61, wherein 'n' is 7 or more (e.g. 8, 10, 12, 14, 16, 18, 20, 25, 30, 35, 40, 50, 60, 70, 80, 90, 100, 150, 200 or more). These sta025 proteins include variants of SEQ ID NO: 61. Preferred fragments of (b) comprise an epitope from SEQ ID NO: 61. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 61 while retaining at least one epitope of SEQ ID NO: 61. The first 19 N-terminal amino acids of SEQ ID NO: 61 can usefully be omitted. Other fragments omit one or more protein domains.

sta026

The 'sta026' antigen is annotated as 'lipoprotein'. In the NCTC 8325 strain sta026 is SAOUHSC_00404 and has amino acid sequence SEQ ID NO: 62 (GI:88194198).

Useful sta026 antigens can elicit an antibody (e.g. when administered to a human) that recognises SEQ ID NO: 62 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 62; and/or (b) comprising a fragment of at least 'n' consecutive amino acids of SEQ ID NO: 62, wherein 'n' is 7 or more (e.g. 8, 10, 12, 14, 16, 18, 20, 25, 30, 35, 40, 50, 60, 70, 80, 90, 100, 150, 200, 250 or more). These sta026 proteins include variants of SEQ ID NO: 62. Preferred fragments of (b) comprise an epitope from SEQ ID NO: 62. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 62 while retaining at least one epitope of SEQ ID NO: 62. The first 22 N-terminal amino acids of SEQ ID NO: 62 can usefully be omitted. Other fragments omit one or more protein domains.

sta027

The 'sta027' antigen is annotated as 'probable lipase'. In the NCTC 8325 strain sta027 is SAOUHSC_00661 and has amino acid sequence SEQ ID NO: 63 (GI:88194426).

Useful sta027 antigens can elicit an antibody (e.g. when administered to a human) that recognises SEQ ID NO: 63 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 63; and/or (b) comprising a fragment of at least 'n' consecutive amino acids of SEQ ID NO: 63, wherein 'n' is 7 or more (e.g. 8, 10, 12, 14, 16, 18, 20, 25, 30, 35, 40, 50, 60, 70, 80, 90, 100, 150, 200, 250 or more). These sta027 proteins include variants of SEQ ID NO: 63. Preferred fragments of (b) comprise an epitope from SEQ ID NO: 63. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 63 while retaining at least one epitope of SEQ ID NO: 63. The first 23 N-terminal amino acids of SEQ ID NO: 63 can usefully be omitted. Other fragments omit one or more protein domains.

sta028

The 'sta028' antigen is annotated as 'secretory antigen SsaA-like protein'. In the NCTC 8325 strain sta028 is SAOUHSC_00671 and has amino acid sequence SEQ ID NO: 64 (GI:88194436). In the Newman strain it is nwmn_0634 (GI: 151220846).

Useful sta028 antigens can elicit an antibody (e.g. when administered to a human) that recognises SEQ ID NO: 64 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 64; and/or (b) comprising a fragment of at least 'n' consecutive amino acids of SEQ ID NO: 64, wherein 'n' is 7 or more (e.g. 8, 10, 12, 14, 16, 18, 20, 25, 30, 35, 40, 50, 60, 70, 80, 90, 100, 150, 200, 250 or more). These sta028 proteins include variants of SEQ ID NO: 64. Preferred fragments of (b) comprise an epitope from SEQ ID NO: 64. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 64 while retaining at least one epitope of SEQ ID NO: 64. The first 25 N-terminal amino acids of SEQ ID NO: 64 can usefully be omitted. Other fragments omit one or more protein domains.

sta029

The 'sta029' antigen is annotated as 'ferrichrome binding protein'. In the NCTC 8325 strain sta029 is SAOUHSC_00754 and has amino acid sequence SEQ ID NO: 65 (GI: 88194518).

Useful sta029 antigens can elicit an antibody (e.g. when administered to a human) that recognises SEQ ID NO: 65 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 65; and/or (b) comprising a fragment of at least 'n' consecutive amino acids of SEQ ID NO: 65, wherein 'n' is 7 or more (e.g. 8, 10, 12, 14, 16, 18, 20, 25, 30, 35, 40, 50, 60, 70, 80, 90, 100, 150, 200, 250 or more). These sta029 proteins include variants of SEQ ID NO: 65. Preferred fragments of (b) comprise an epitope from SEQ ID NO: 65. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 65 while retaining at least one epitope of SEQ ID NO: 65. The final 25 C-terminal amino acids of SEQ ID NO: 65 can usefully be omitted. The first 19 N-terminal amino acids of SEQ ID NO: 65 can usefully be omitted. Other fragments omit one or more protein domains.

sta030

The 'sta030' antigen is annotated as 'lipoprotein'. In the NCTC 8325 strain sta030 is SAOUHSC_00808 and has amino acid sequence SEQ ID NO: 66 (GI:88194568).

Useful sta030 antigens can elicit an antibody (e.g. when administered to a human) that recognises SEQ ID NO: 66 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 66; and/or (b) comprising a fragment of at least 'n' consecutive amino acids of SEQ ID NO: 66, wherein 'n' is 7 or more (e.g. 8, 10, 12, 14, 16, 18, 20, 25, 30, 35, 40, 50, 60, 70, 80, 90, 100, 150, 200 or more). These sta030 proteins include variants of SEQ ID NO: 66. Preferred fragments of (b) comprise an epitope from SEQ ID NO: 66. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 66 while retaining at least one epitope of SEQ ID NO: 66. The first 17 N-terminal amino acids of SEQ ID NO: 66 can usefully be omitted. Other fragments omit one or more protein domains.

sta031

The 'sta031' antigen is annotated as '5-nucleotidase family protein'. In the NCTC 8325 strain sta031 is SAOUHSC_00860 and has amino acid sequence SEQ ID NO: 67 (GI: 88194617).

Useful sta031 antigens can elicit an antibody (e.g. when administered to a human) that recognises SEQ ID NO: 67 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 67; and/or (b) comprising a fragment of at least 'n' consecutive amino acids of SEQ ID NO: 67, wherein 'n' is 7 or more (e.g. 8, 10, 12, 14, 16, 18, 20, 25, 30, 35, 40, 50, 60, 70, 80, 90, 100, 150, 200, 250 or more). These sta031 proteins include variants of SEQ ID NO: 67. Preferred fragments of (b) comprise an epitope from SEQ ID NO: 67. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 67 while retaining at least one epitope of SEQ ID NO: 67. Other fragments omit one or more protein domains.

sta032

The 'sta032' antigen is annotated as 'serine protease HtrA'. In the NCTC 8325 strain sta032 is SAOUHSC_00958 and has amino acid sequence SEQ ID NO: 68 (GI:88194715).

Useful sta032 antigens can elicit an antibody (e.g. when administered to a human) that recognises SEQ ID NO: 68 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 68; and/or (b) comprising a fragment of at least 'n' consecutive amino acids of SEQ ID NO: 68, wherein 'n' is 7 or more (e.g. 8, 10, 12, 14, 16, 18, 20, 25, 30, 35, 40, 50, 60, 70, 80, 90, 100, 150, 200, 250 or more). These sta032 proteins include variants of SEQ ID NO: 68. Preferred fragments of (b) comprise an epitope from SEQ ID NO: 68. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 68 while retaining at least one epitope of SEQ ID NO: 68. Other fragments omit one or more protein domains.

sta033

The 'sta033' antigen is annotated as 'cysteine protease precursor'. In the NCTC 8325 strain sta033 is SAOUHSC_00987 and has amino acid sequence SEQ ID NO: 69 (GI: 88194744).

Useful sta033 antigens can elicit an antibody (e.g. when administered to a human) that recognises SEQ ID NO: 69 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 69; and/or (b) comprising a fragment of at least 'n' consecutive amino acids of SEQ ID NO: 69, wherein 'n' is 7 or more (e.g. 8, 10, 12, 14, 16, 18, 20, 25, 30, 35, 40, 50, 60, 70, 80, 90, 100, 150, 200, 250 or more). These sta033 proteins include variants of SEQ ID NO: 69. Preferred fragments of (b) comprise an epitope from SEQ ID NO: 69. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 69 while retaining at least one epitope of SEQ ID NO: 69. The first 29 N-terminal amino acids of SEQ ID NO: 69 can usefully be omitted. Other fragments omit one or more protein domains.

sta034

The 'sta034' antigen is annotated as 'glutamyl endopeptidase precursor'. In the NCTC 8325 strain sta034 is SAOUHSC_00988 and has amino acid sequence SEQ ID NO: 70 (GI:88194745).

Useful sta034 antigens can elicit an antibody (e.g. when administered to a human) that recognises SEQ ID NO: 70 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 70; and/or (b) comprising a fragment of at least 'n' consecutive amino acids of SEQ ID NO: 70, wherein 'n' is 7 or more (e.g. 8, 10, 12, 14, 16, 18, 20, 25, 30, 35, 40, 50, 60, 70, 80, 90, 100, 150, 200, 250 or more). These sta034 proteins include variants of SEQ ID NO: 70. Preferred fragments of (b) comprise an epitope from SEQ ID NO: 70. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 70 while retaining at least one epitope of SEQ ID NO: 70. The first 29 N-terminal amino acids of SEQ ID NO: 70 can usefully be omitted. Other fragments omit one or more protein domains.

sta035

The 'sta035' antigen is annotated as 'fmt protein'. In the NCTC 8325 strain sta035 is SAOUHSC_00998 and has amino acid sequence SEQ ID NO: 71 (GI:88194754).

Useful sta035 antigens can elicit an antibody (e.g. when administered to a human) that recognises SEQ ID NO: 71 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 71; and/or (b) comprising a fragment of at least 'n' consecutive amino acids of SEQ ID NO: 71, wherein 'n' is 7 or more (e.g. 8, 10, 12, 14, 16, 18, 20, 25, 30, 35, 40, 50, 60, 70, 80, 90, 100, 150, 200, 250 or more). These sta035 proteins include variants of SEQ ID NO: 71. Preferred fragments of (b) comprise an epitope from SEQ ID NO: 71. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 71 while retaining at least one epitope of SEQ ID NO: 71. The first 25 N-terminal amino acids of SEQ ID NO: 71 can usefully be omitted. Other fragments omit one or more protein domains.

sta036

The 'sta036' antigen is annotated as 'iron-regulated protein with leader'. In the NCTC 8325 strain sta036 is SAOUHSC_01084 and has amino acid sequence SEQ ID NO: 72 (GI: 88194831).

Useful sta036 antigens can elicit an antibody (e.g. when administered to a human) that recognises SEQ ID NO: 72 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 72; and/or (b) comprising a fragment of at least 'n' consecutive amino acids of SEQ ID NO: 72, wherein 'n' is 7 or more (e.g. 8, 10, 12, 14, 16, 18, 20, 25, 30, 35, 40, 50, 60, 70, 80, 90, 100, 150, 200, 250 or more). These sta036 proteins include variants of SEQ ID NO: 72. Preferred fragments of (b) comprise an epitope from SEQ ID NO: 72. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 72 while retaining at least one epitope of SEQ ID NO: 72. The final 27 C-terminal amino acids of SEQ ID NO: 72 can usefully be omitted. The first 32 N-terminal amino acids of SEQ ID NO: 72 can usefully be omitted. Other fragments omit one or more protein domains.

sta037

The 'sta037' antigen is annotated as 'iron ABC transporter; iron-binding protein IsdE'. In the NCTC 8325 strain sta037 is SAOUHSC_01085 and has amino acid sequence SEQ ID NO: 73 (GI:88194832).

Useful sta037 antigens can elicit an antibody (e.g. when administered to a human) that recognises SEQ ID NO: 73 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 73; and/or (b) comprising a fragment of at least 'n' consecutive amino acids of SEQ ID NO: 73, wherein 'n' is 7 or more (e.g. 8, 10, 12, 14, 16, 18, 20, 25, 30, 35, 40, 50, 60, 70, 80, 90, 100, 150, 200, 250 or more). These sta037 proteins include variants of SEQ ID NO: 73. Preferred fragments of (b) comprise an epitope from SEQ ID NO: 73. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 73 while retaining at least one epitope of SEQ ID NO: 73. The first 9 N-terminal amino acids of SEQ ID NO: 73 can usefully be omitted. Other fragments omit one or more protein domains.

sta038

The 'sta038' antigen is annotated as 'NPQTN specific sortase B'. In the NCTC 8325 strain sta038 is SAOUHSC_01088 and has amino acid sequence SEQ ID NO: 74 (GI: 88194835).

Useful sta038 antigens can elicit an antibody (e.g. when administered to a human) that recognises SEQ ID NO: 74 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 74; and/or (b) comprising a fragment of at least 'n' consecutive amino acids of SEQ ID NO: 74, wherein 'n' is 7 or more (e.g. 8, 10, 12, 14, 16, 18, 20, 25, 30, 35, 40, 50, 60, 70, 80, 90, 100, 150, 200 or more). These sta038 proteins include variants of SEQ ID NO: 74. Preferred fragments of (b) comprise an epitope from SEQ ID NO: 74. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 74 while retaining at least one epitope of SEQ ID NO: 74. The first 21 N-terminal amino acids of SEQ ID NO: 74 can usefully be omitted. Other fragments omit one or more protein domains.

sta039

The 'sta039' antigen is annotated as 'superantigen-like protein'. In the NCTC 8325 strain sta039 is SAOUHSC_01124 and has amino acid sequence SEQ ID NO: 75 (GI: 88194868).

Useful sta039 antigens can elicit an antibody (e.g. when administered to a human) that recognises SEQ ID NO: 75 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 75; and/or (b) comprising a fragment of at least 'n' consecutive amino acids of SEQ ID NO: 75, wherein is 7 or more (e.g. 8, 10, 12, 14, 16, 18, 20, 25, 30, 35, 40, 50, 60, 70, 80, 90, 100, 150, 200 or more). These sta039 proteins include variants of SEQ ID NO: 75. Preferred fragments of (b) comprise an epitope from SEQ ID NO: 75. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 75 while retaining at least one epitope of SEQ ID NO: 75. The first 22 N-terminal amino acids of SEQ ID NO: 75 can usefully be omitted. Other fragments omit one or more protein domains.

sta040

The 'sta040' antigen is annotated as 'superantigen-like protein'. In the NCTC 8325 strain sta040 is SAOUHSC_01125 and has amino acid sequence SEQ ID NO: 76 (GI: 88194869). In the Newman strain it is nwmn_1076 (GI: 151221288).

Useful sta040 antigens can elicit an antibody (e.g. when administered to a human) that recognises SEQ ID NO: 76 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 76; and/or (b) comprising a fragment of at least 'n' consecutive amino acids of SEQ ID NO: 76, wherein 'n' is 7 or more (e.g. 8, 10, 12, 14, 16, 18, 20, 25, 30, 35, 40, 50, 60, 70, 80, 90, 100, 150, 200 or more). These sta040 proteins include variants of SEQ ID NO: 76. Preferred fragments of (b) comprise an epitope from SEQ ID NO: 76. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 76 while retaining at least one epitope of SEQ ID NO: 76. The first 21 N-terminal amino acids of SEQ ID NO: 76 can usefully be omitted. Other fragments omit one or more protein domains.

sta041

The 'sta041' antigen is annotated as 'fibronectin-binding protein A-related'. In the NCTC 8325 strain sta041 is SAOUHSC_01175 and has amino acid sequence SEQ ID NO: 77 (GI:88194914).

Useful sta041 antigens can elicit an antibody (e.g. when administered to a human) that recognises SEQ ID NO: 77 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 77; and/or (b) comprising a fragment of at least 'n' consecutive amino acids of SEQ ID NO: 77, wherein 'n' is 7 or more (e.g. 8, 10, 12, 14, 16, 18, 20, 25, 30, 35, 40, 50, 60, 70, 80, 90, 100, 150, 200, 250 or more). These sta041 proteins include variants of SEQ ID NO: 77. Preferred fragments of (b) comprise an epitope from SEQ ID NO: 77. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 77 while retaining at least one epitope of SEQ ID NO: 77. Other fragments omit one or more protein domains.

sta042

The 'sta042' antigen is annotated as 'lipoprotein'. In the NCTC 8325 strain sta042 is SAOUHSC_01180 and has amino acid sequence SEQ ID NO: 78 (GI:88194919).

Useful sta042 antigens can elicit an antibody (e.g. when administered to a human) that recognises SEQ ID NO: 78 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 78; and/or (b) comprising a fragment of at least 'n' consecutive amino acids of SEQ ID NO: 78, wherein 'n' is 7 or more (e.g. 8, 10, 12, 14, 16, 18, 20, 25, 30, 35, 40, 50, 60, 70, 80, 90, 100, 150, 200, 250 or more). These sta042 proteins include variants of SEQ ID NO: 78. Preferred fragments of (b) comprise an epitope from SEQ ID NO: 78. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 78 while retaining at least one epitope of SEQ ID NO: 78. The first 18 N-terminal amino acids of SEQ ID NO: 78 can usefully be omitted. Other fragments omit one or more protein domains.

sta043

The 'sta043' antigen is annotated as 'cell wall hydrolase'. In the NCTC 8325 strain sta043 is SAOUHSC_01219 and has amino acid sequence SEQ ID NO: 79 (GI:88194955).

Useful sta043 antigens can elicit an antibody (e.g. when administered to a human) that recognises SEQ ID NO: 79 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 79; and/or (b) comprising a fragment of at least 'n' consecutive amino acids of SEQ ID NO: 79, wherein 'n' is 7 or more (e.g. 8, 10, 12, 14, 16, 18, 20, 25, 30, 35, 40, 50, 60, 70, 80, 90, 100, 150, 200, 250 or more). These sta043 proteins include variants of SEQ ID NO: 79. Preferred fragments of (b) comprise an epitope from SEQ ID NO: 79. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 79 while retaining at least one epitope of SEQ ID NO: 79. The first 38 N-terminal amino acids of SEQ ID NO: 79 can usefully be omitted. Other fragments omit one or more protein domains.

sta044

The 'sta044' antigen is annotated as 'lipoprotein'. In the NCTC 8325 strain sta044 is SAOUHSC_01508 and has amino acid sequence SEQ ID NO: 80 (GI:88195223).

Useful sta044 antigens can elicit an antibody (e.g. when administered to a human) that recognises SEQ ID NO: 80 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 80; and/or (b) comprising a fragment of at least 'n' consecutive amino acids of SEQ ID NO: 80, wherein 'n' is 7 or more (e.g. 8, 10, 12, 14, 16, 18, 20, 25, 30, 35, 40, 50, 60, 70, 80, 90, 100, 150, 200, 250 or more). These sta044 proteins include variants of SEQ ID NO: 80. Preferred fragments of (b) comprise an epitope from SEQ ID NO: 80. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 80 while retaining at least one epitope of SEQ ID NO: 80. The first 17 N-terminal amino acids of SEQ ID NO: 80 can usefully be omitted. Other fragments omit one or more protein domains.

sta045

The 'sta045' antigen is annotated as 'lipoprotein'. In the NCTC 8325 strain sta045 is SAOUHSC_01627 and has amino acid sequence SEQ ID NO: 81 (GI:88195337).

Useful sta045 antigens can elicit an antibody (e.g. when administered to a human) that recognises SEQ ID NO: 81 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 81; and/or (b) comprising a fragment of at least 'n' consecutive amino acids of SEQ ID NO: 81, wherein 'n' is 7 or more (e.g. 8, 10, 12, 14, 16, 18, 20, 25, 30, 35, 40, 50, 60, 70, 80, 90, 100, 150 or more). These sta045 proteins include variants of SEQ ID NO: 81. Preferred fragments of (b) comprise an epitope from SEQ ID NO: 81. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 81 while retaining at least one epitope of SEQ ID NO: 81. The first 16 N-terminal amino acids of SEQ ID NO: 81 can usefully be omitted. Other fragments omit one or more protein domains.

sta046

The 'sta046' antigen is annotated as 'Excalibur protein'. In the NCTC 8325 strain sta046 is SAOUHSC_01918 and has amino acid sequence SEQ ID NO: 82 (GI:88195613).

Useful sta046 antigens can elicit an antibody (e.g. when administered to a human) that recognises SEQ ID NO: 82 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 82; and/or (b) comprising a fragment of at least 'n' consecutive amino acids of SEQ ID NO: 82, wherein 'n' is 7 or more (e.g. 8, 10, 12, 14, 16, 18, 20, 25, 30, 35, 40, 50, 60, 70, 80, 90, 100, 150, 200 or more). These sta046 proteins include variants of SEQ ID NO: 82. Preferred fragments of (b) comprise an epitope from SEQ ID NO: 82. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 82 while retaining at least one epitope of SEQ ID NO: 82. The first 53 N-terminal amino acids of SEQ ID NO: 82 can usefully be omitted. Other fragments omit one or more protein domains.

sta047

The 'sta047' antigen is annotated as 'lipoprotein'. In the NCTC 8325 strain sta047 is SAOUHSC_01920 and has amino acid sequence SEQ ID NO: 83 (GI:88195615).

Useful sta047 antigens can elicit an antibody (e.g. when administered to a human) that recognises SEQ ID NO: 83 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 83; and/or (b) comprising a fragment of at least 'n' consecutive amino acids of SEQ ID NO: 83, wherein 'n' is 7 or more (e.g. 8, 10, 12, 14, 16, 18, 20, 25, 30, 35, 40, 50, 60, 70, 80, 90, 100, 150, 200 or more). These sta047 proteins include variants of SEQ ID NO: 83. Preferred fragments of (b) comprise an epitope from SEQ ID NO: 83. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 83 while retaining at least one epitope of SEQ ID NO: 83. The first 18 N-terminal amino acids of SEQ ID NO: 83 can usefully be omitted. Other fragments omit one or more protein domains.

sta048

The 'sta048' antigen is annotated as 'intracellular serine protease'. In the NCTC 8325 strain sta048 is SAOUHSC_01949 and has amino acid sequence SEQ ID NO: 84 (GI:88195642).

Useful sta048 antigens can elicit an antibody (e.g. when administered to a human) that recognises SEQ ID NO: 84 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 84; and/or (b) comprising a fragment of at least 'n' consecutive amino acids of SEQ ID NO: 84, wherein 'n' is 7 or more (e.g. 8, 10, 12, 14, 16, 18, 20, 25, 30, 35, 40, 50, 60, 70, 80, 90, 100, 150, 200, 250 or more). These sta048 proteins include variants of SEQ ID NO: 84. Preferred fragments of (b) comprise an epitope from SEQ ID NO: 84. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 84 while retaining at least one epitope of SEQ ID NO: 84. The first 27 N-terminal amino acids of SEQ ID NO: 84 can usefully be omitted. Other fragments omit one or more protein domains.

sta049

The 'sta049' antigen is annotated as 'protein export protein PrsA'. In the NCTC 8325 strain sta049 is SAOUHSC_01972 and has amino acid sequence SEQ ID NO: 85 (GI:88195663). In the Newman strain it is nwmn_1733 (GI:151221945).

Useful sta049 antigens can elicit an antibody (e.g. when administered to a human) that recognises SEQ ID NO: 85 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 85; and/or (b) comprising a fragment of at least 'n' consecutive amino acids of SEQ ID NO: 85, wherein 'n' is 7 or more (e.g. 8, 10, 12, 14, 16, 18, 20, 25, 30, 35, 40, 50, 60, 70, 80, 90, 100, 150, 200, 250 or more). These sta049 proteins include variants of SEQ ID NO: 85. Preferred fragments of (b) comprise an epitope from SEQ ID NO: 85. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 85 while retaining at least one epitope of SEQ ID NO: 85. The first 25 N-terminal amino acids of SEQ ID NO: 85 can usefully be omitted. Other fragments omit one or more protein domains.

sta050

The 'sta050' antigen is annotated as 'staphopain thiol proteinase'. In the NCTC 8325 strain sta050 is SAOUHSCO_2127 and has amino acid sequence SEQ ID NO: 86 (GI: 88195808).

Useful sta050 antigens can elicit an antibody (e.g. when administered to a human) that recognises SEQ ID NO: 86 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 86; and/or (b) comprising a fragment of at least 'n' consecutive amino acids of SEQ ID NO: 86, wherein 'n' is 7 or more (e.g. 8, 10, 12, 14, 16, 18, 20, 25, 30, 35, 40, 50, 60, 70, 80, 90, 100, 150, 200, 250 or more). These sta050 proteins include variants of SEQ ID NO: 86. Preferred fragments of (b) comprise an epitope from SEQ ID NO: 86. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 86 while retaining at least one epitope of SEQ ID NO: 86. The first 25 N-terminal amino acids of SEQ ID NO: 86 can usefully be omitted. Other fragments omit one or more protein domains.

sta051

The 'sta051' antigen is annotated as 'protein with leader'. In the NCTC 8325 strain sta051 is SAOUHSCO_2147 and has amino acid sequence SEQ ID NO: 87 (GI:88195827).

Useful sta051 antigens can elicit an antibody (e.g. when administered to a human) that recognises SEQ ID NO: 87 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 87; and/or (b) comprising a fragment of at least 'n' consecutive amino acids of SEQ ID NO: 87, wherein 'n' is 7 or more (e.g. 8, 10, 12, 14, 16, 18, 20, 25, 30, 35, 40, 50, 60, 70, 80, 90, 100, 150, 200, 250 or more). These sta051 proteins include variants of SEQ ID NO: 87. Preferred fragments of (b) comprise an epitope from SEQ ID NO: 87. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 87 while retaining at least one epitope of SEQ ID NO: 87. The first 24 N-terminal amino acids of SEQ ID NO: 87 can usefully be omitted. Other fragments omit one or more protein domains.

sta052

The 'sta052' antigen is annotated as 'ferric hydroxamate receptor 1'. In the NCTC 8325 strain sta052 is SAOUHSC_02246 and has amino acid sequence SEQ ID NO: 88 (GI: 88195918).

Useful sta052 antigens can elicit an antibody (e.g. when administered to a human) that recognises SEQ ID NO: 88 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 88; and/or (b) comprising a fragment of at least 'n' consecutive amino acids of SEQ ID NO: 88, wherein 'n' is 7 or more (e.g. 8, 10, 12, 14, 16, 18, 20, 25, 30, 35, 40, 50, 60, 70, 80, 90, 100, 150, 200, 250 or more). These sta052 proteins include variants of SEQ ID NO: 88. Preferred fragments of (b) comprise an epitope from SEQ ID NO: 88. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 88 while retaining at least one epitope of SEQ ID NO: 88. The first 17 N-terminal amino acids of SEQ ID NO: 88 can usefully be omitted. Other fragments omit one or more protein domains.

sta053

The 'sta053' antigen is annotated as 'srdH family protein'. In the NCTC 8325 strain sta053 is SAOUHSC_02257 and has amino acid sequence SEQ ID NO: 89 (GI:88195928).

Useful sta053 antigens can elicit an antibody (e.g. when administered to a human) that recognises SEQ ID NO: 89 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 89; and/or (b) comprising a fragment of at least 'n' consecutive amino acids of SEQ ID NO: 89, wherein 'n' is 7 or more (e.g. 8, 10, 12, 14, 16, 18, 20, 25, 30, 35, 40, 50, 60, 70, 80, 90, 100, 150, 200, 250 or more). These sta053 proteins include variants of SEQ ID NO: 89. Preferred fragments of (b) comprise an epitope from SEQ ID NO: 89. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 89 while retaining at least one epitope of SEQ ID NO: 89. The first 26 N-terminal amino acids of SEQ ID NO: 89 can usefully be omitted. Other fragments omit one or more protein domains.

sta054

The 'sta054' antigen is annotated as 'Probable transglycosylase isaA precursor'. In the NCTC 8325 strain sta054 is SAOUHSC_02333 and has amino acid sequence SEQ ID NO: 90 (GI:88195999).

Useful sta054 antigens can elicit an antibody (e.g. when administered to a human) that recognises SEQ ID NO: 90 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 90; and/or (b) comprising a fragment of at least 'n' consecutive amino acids of SEQ ID NO: 90, wherein 'n' is 7 or more (e.g. 8, 10, 12, 14, 16, 18, 20, 25, 30, 35, 40, 50, 60, 70, 80, 90, 100, 150, 200 or more). These sta054 proteins include variants of SEQ ID NO: 90. Preferred fragments of (b) comprise an epitope from SEQ ID NO: 90. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 90 while retaining at least one epitope of SEQ ID NO: 90. The first 27 N-terminal amino acids of SEQ ID NO: 90 can usefully be omitted. Other fragments omit one or more protein domains.

sta055

The 'sta055' antigen is annotated as 'surface hydrolase'. In the NCTC 8325 strain sta055 is SAOUHSC_02448 and has amino acid sequence SEQ ID NO: 91 (GI:88196100).

Useful sta055 antigens can elicit an antibody (e.g. when administered to a human) that recognises SEQ ID NO: 91 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 91; and/or (b) comprising a fragment of at least 'n' consecutive amino acids of SEQ ID NO: 91, wherein 'n' is 7 or more (e.g. 8, 10, 12, 14, 16, 18, 20, 25, 30, 35, 40, 50, 60, 70, 80, 90, 100, 150, 200, 250 or more). These sta055 proteins include variants of SEQ ID NO: 91. Preferred fragments of (b) comprise an epitope from SEQ ID NO: 91. Other preferred fragments lack one or more amino acids (e.g.

1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 91 while retaining at least one epitope of SEQ ID NO: 91. The first 31 N-terminal amino acids of SEQ ID NO: 91 can usefully be omitted. Other fragments omit one or more protein domains.

sta056

The 'sta056' antigen is annotated as 'hyaluronate lyase'. In the NCTC 8325 strain sta056 is SAOUHSC_02463 and has amino acid sequence SEQ ID NO: 92 (GI:88196115).

Useful sta056 antigens can elicit an antibody (e.g. when administered to a human) that recognises SEQ ID NO: 92 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 92; and/or (b) comprising a fragment of at least 'n' consecutive amino acids of SEQ ID NO: 92, wherein 'n' is 7 or more (e.g. 8, 10, 12, 14, 16, 18, 20, 25, 30, 35, 40, 50, 60, 70, 80, 90, 100, 150, 200, 250 or more). These sta056 proteins include variants of SEQ ID NO: 92. Preferred fragments of (b) comprise an epitope from SEQ ID NO: 92. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 92 while retaining at least one epitope of SEQ ID NO: 92. The first 24 N-terminal amino acids of SEQ ID NO: 92 can usefully be omitted. Other fragments omit one or more protein domains.

sta057

The 'sta057' antigen is annotated as 'secretory antigen precursor SsaA'. In the NCTC 8325 strain sta057 is SAOUHSC_02576 and has amino acid sequence SEQ ID NO: 93 (GI:88196220). In the Newman strain it is nwmn_2203 (GI: 151222415).

Useful sta057 antigens can elicit an antibody (e.g. when administered to a human) that recognises SEQ ID NO: 93 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 93; and/or (b) comprising a fragment of at least 'n' consecutive amino acids of SEQ ID NO: 93, wherein 'n' is 7 or more (e.g. 8, 10, 12, 14, 16, 18, 20, 25, 30, 35, 40, 50, 60, 70, 80, 90, 100, 150 or more). These sta057 proteins include variants of SEQ ID NO: 93. Preferred fragments of (b) comprise an epitope from SEQ ID NO: 93. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 93 while retaining at least one epitope of SEQ ID NO: 93. The first 27 N-terminal amino acids of SEQ ID NO: 93 can usefully be omitted. Other fragments omit one or more protein domains.

sta058

The 'sta058' antigen is annotated as 'Zn-binding lipoprotein adcA-like'. In the NCTC 8325 strain sta058 is SAOUHSC_02690 and has amino acid sequence SEQ ID NO: 94 (GI:88196330).

Useful sta058 antigens can elicit an antibody (e.g. when administered to a human) that recognises SEQ ID NO: 94 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 94; and/or (b) comprising a fragment of at least 'n' consecutive amino acids of SEQ ID NO: 94, wherein 'n' is 7 or more (e.g. 8, 10, 12, 14, 16, 18, 20, 25, 30, 35, 40, 50, 60, 70, 80, 90, 100, 150, 200, 250 or more). These sta058 proteins include variants of SEQ ID NO: 94. Preferred fragments of (b) comprise an epitope from SEQ ID NO: 94. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 94 while retaining at least one epitope of SEQ ID NO: 94. The first 20 N-terminal amino acids of SEQ ID NO: 94 can usefully be omitted. Other fragments omit one or more protein domains.

sta059

The 'sta059' antigen is annotated as 'gamma-hemolysin h-gamma-ii subunit'. In the NCTC 8325 strain sta059 is SAOUHSC_02708 and has amino acid sequence SEQ ID NO: 95 (GI:88196348).

Useful sta059 antigens can elicit an antibody (e.g. when administered to a human) that recognises SEQ ID NO: 95 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 95; and/or (b) comprising a fragment of at least 'n' consecutive amino acids of SEQ ID NO: 95, wherein 'n' is 7 or more (e.g. 8, 10, 12, 14, 16, 18, 20, 25, 30, 35, 40, 50, 60, 70, 80, 90, 100, 150, 200, 250 or more). These sta059 proteins include variants of SEQ ID NO: 95. Preferred fragments of (b) comprise an epitope from SEQ ID NO: 95. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 95 while retaining at least one epitope of SEQ ID NO: 95. The first 20 N-terminal amino acids of SEQ ID NO: 95 can usefully be omitted. Other fragments omit one or more protein domains.

sta060

The 'sta060' antigen is annotated as 'peptide ABC transporter; peptide-binding protein'. In the NCTC 8325 strain sta060 is SAOUHSC_02767 and has amino acid sequence SEQ ID NO: 96 (GI:88196403).

Useful sta060 antigens can elicit an antibody (e.g. when administered to a human) that recognises SEQ ID NO: 96 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 96; and/or (b) comprising a fragment of at least 'n' consecutive amino acids of SEQ ID NO: 96, wherein 'n' is 7 or more (e.g. 8, 10, 12, 14, 16, 18, 20, 25, 30, 35, 40, 50, 60, 70, 80, 90, 100, 150, 200, 250 or more). These sta060 proteins include variants of SEQ ID NO: 96. Preferred fragments of (b) comprise an epitope from SEQ ID NO: 96. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 96 while retaining at least one epitope of SEQ ID NO: 96. The first 20 N-terminal amino acids of SEQ ID NO: 96 can usefully be omitted. Other fragments omit one or more protein domains.

sta061

The 'sta061' antigen is annotated as 'protein with leader'. In the NCTC 8325 strain sta061 is SAOUHSC_02783 and has amino acid sequence SEQ ID NO: 97 (GI:88196419).

Useful sta061 antigens can elicit an antibody (e.g. when administered to a human) that recognises SEQ ID NO: 97 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 97; and/or (b) comprising a fragment of at least 'n' consecutive amino acids of SEQ ID NO: 97, wherein 'n' is 7 or more (e.g. 8, 10, 12, 14, 16, 18, 20, 25, 30, 35, 40, 50, 60, 70, 80, 90, 100, 150, 200, 250 or more). These sta061 proteins include variants of SEQ ID NO: 97. Preferred fragments of (b) comprise an epitope from SEQ ID NO: 97. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 97 while retaining at least one epitope of SEQ ID NO: 97. The first 21 N-terminal amino acids of SEQ ID NO: 97 can usefully be omitted. Other fragments omit one or more protein domains.

sta062

The 'sta062' antigen is annotated as 'protein with leader'. In the NCTC 8325 strain sta062 is SAOUHSC_02788 and has amino acid sequence SEQ ID NO: 98 (GI:88196424).

Useful sta062 antigens can elicit an antibody (e.g. when administered to a human) that recognises SEQ ID NO: 98 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 98; and/or (b) comprising a fragment of at least 'n' consecutive amino acids of SEQ ID NO: 98, wherein 'n' is 7 or more (e.g. 8, 10, 12, 14, 16, 18, 20, 25, 30, 35, 40, 50, 60, 70, 80, 90, 100, 150, 200, 250 or more). These sta062 proteins include variants of SEQ ID NO: 98. Preferred fragments of (b) comprise an epitope from SEQ ID NO: 98. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 98 while retaining at least one epitope of SEQ ID NO: 98. The first 22 N-terminal amino acids of SEQ ID NO: 98 can usefully be omitted. Other fragments omit one or more protein domains.

sta063

The 'sta063' antigen is annotated as 'aureolysin'. In the NCTC 8325 strain sta063 is SAOUHSC_02971 and has amino acid sequence SEQ ID NO: 99 (GI:88196592).

Useful sta063 antigens can elicit an antibody (e.g. when administered to a human) that recognises SEQ ID NO: 99 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 99; and/or (b) comprising a fragment of at least 'n' consecutive amino acids of SEQ ID NO: 99, wherein 'n' is 7 or more (e.g. 8, 10, 12, 14, 16, 18, 20, 25, 30, 35, 40, 50, 60, 70, 80, 90, 100, 150, 200, 250 or more). These sta063 proteins include variants of SEQ ID NO: 99. Preferred fragments of (b) comprise an epitope from SEQ ID NO: 99. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 99 while retaining at least one epitope of SEQ ID NO: 99. The first 16 N-terminal amino acids of SEQ ID NO: 99 can usefully be omitted. Other fragments omit one or more protein domains.

sta064

The 'sta064' antigen is annotated as 'lipase'. In the NCTC 8325 strain sta064 is SAOUHSC_03006 and has amino acid sequence SEQ ID NO: 100 (GI:88196625). In the Newman strain it is nwmn_2569 (GI:151222781).

Useful sta064 antigens can elicit an antibody (e.g. when administered to a human) that recognises SEQ ID NO: 100 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 100; and/or (b) comprising a fragment of at least 'n' consecutive amino acids of SEQ ID NO: 100, wherein 'n' is 7 or more (e.g. 8, 10, 12, 14, 16, 18, 20, 25, 30, 35, 40, 50, 60, 70, 80, 90, 100, 150, 200, 250 or more). These sta064 proteins include variants of SEQ ID NO: 100. Preferred fragments of (b) comprise an epitope from SEQ ID NO: 100. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 100 while retaining at least one epitope of SEQ ID NO: 100. The first 34 N-terminal amino acids of SEQ ID NO: 100 can usefully be omitted. Other fragments omit one or more protein domains.

sta065

The 'sta065' antigen is annotated as '1-phosphatidylinositol phosphodiesterase precursor'. In the NCTC 8325 strain sta065 is SAOUHSC_00051 and has amino acid sequence SEQ ID NO: 101 (GI:88193871).

Useful sta065 antigens can elicit an antibody (e.g. when administered to a human) that recognises SEQ ID NO: 101 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 101; and/or (b) comprising a fragment of at least 'n' consecutive amino acids of SEQ ID NO: 101, wherein 'n' is 7 or more (e.g. 8, 10, 12, 14, 16, 18, 20, 25, 30, 35, 40, 50, 60, 70, 80, 90, 100, 150, 200, 250 or more). These sta065 proteins include variants of SEQ ID NO: 101. Preferred fragments of (b) comprise an epitope from SEQ ID NO: 101. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 101 while retaining at least one epitope of SEQ ID NO: 101. The first 26 N-terminal amino acids of SEQ ID NO: 101 can usefully be omitted. Other fragments omit one or more protein domains.

sta066

The 'sta066' antigen is annotated as 'protein'. In the NCTC 8325 strain sta066 is SAOUHSC_00172 and has amino acid sequence SEQ ID NO: 102 (GI:88193982).

Useful sta066 antigens can elicit an antibody (e.g. when administered to a human) that recognises SEQ ID NO: 102 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 102; and/or (b) comprising a fragment of at least 'n' consecutive amino acids of SEQ ID NO: 102, wherein 'n' is 7 or more (e.g. 8, 10, 12, 14, 16, 18, 20, 25, 30, 35, 40, 50, 60, 70, 80, 90, 100, 150, 200, 250 or more). These sta066 proteins include variants of SEQ ID NO: 102. Preferred fragments of (b) comprise an epitope from SEQ ID NO: 102. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 102 while retaining at least one epitope of SEQ ID NO: 102. The first 21 N-terminal amino acids of SEQ ID NO: 102 can usefully be omitted. Other fragments omit one or more protein domains.

sta067

The 'sta067' antigen is annotated as 'bacterial extracellular solute-binding protein'. In the NCTC 8325 strain sta067 is SAOUHSC_00176 and has amino acid sequence SEQ ID NO: 103 (GI:88193986).

Useful sta067 antigens can elicit an antibody (e.g. when administered to a human) that recognises SEQ ID NO: 103 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 103; and/or (b) comprising a fragment of at least 'n' consecutive amino acids of SEQ ID NO: 103, wherein 'n' is 7 or more (e.g. 8, 10, 12, 14, 16, 18, 20, 25, 30, 35, 40, 50, 60, 70, 80, 90, 100, 150, 200, 250 or more). These sta067 proteins include variants of SEQ ID NO: 103. Preferred fragments of (b) comprise an epitope from SEQ ID NO: 103. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 103 while retaining at least one epitope of SEQ ID NO: 103. The first 20 N-terminal amino acids of SEQ ID NO: 103 can usefully be omitted. Other fragments omit one or more protein domains.

sta068

The 'sta068' antigen is annotated as 'iron permease FTR1'. In the NCTC 8325 strain sta068 is SAOUHSC_00327 and has amino acid sequence SEQ ID NO: 104 (GI:88194127).

Useful sta068 antigens can elicit an antibody (e.g. when administered to a human) that recognises SEQ ID NO: 104 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 104; and/or (b) comprising a fragment of at least 'n' consecutive amino acids of SEQ ID NO: 104, wherein 'n' is 7 or more (e.g. 8, 10, 12, 14, 16, 18, 20, 25, 30, 35, 40, 50, 60, 70, 80, 90, 100, 150, 200, 250 or more). These sta068 proteins include variants of SEQ ID NO: 104. Preferred fragments of (b) comprise an epitope from SEQ ID NO: 104. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 104 while retaining at least one epitope of SEQ ID NO: 104. The final 20 C-terminal amino acids of SEQ ID NO: 104 can usefully be omitted. The first 14 N-terminal amino acids of SEQ ID NO: 104 can usefully be omitted. Other fragments omit one or more protein domains.

sta069

The 'sta069' antigen is annotated as 'autolysin precursor'. In the NCTC 8325 strain sta069 is SAOUHSC_00427 and has amino acid sequence SEQ ID NO: 105 (GI:88194219).

Useful sta069 antigens can elicit an antibody (e.g. when administered to a human) that recognises SEQ ID NO: 105 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 105; and/or (b) comprising a fragment of at least 'n' consecutive amino acids of SEQ ID NO: 105, wherein 'n' is 7 or more (e.g. 8, 10, 12, 14, 16, 18, 20, 25, 30, 35, 40, 50, 60, 70, 80, 90, 100, 150, 200, 250 or more). These sta069 proteins include variants of SEQ ID NO: 105. Preferred fragments of (b) comprise an epitope from SEQ ID NO: 105. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 105 while retaining at least one epitope of SEQ ID NO: 105. The first 25 N-terminal amino acids of SEQ ID NO: 105 can usefully be omitted. Other fragments omit one or more protein domains.

sta070

The 'sta070' antigen is annotated as 'immunogenic secreted precursor-like protein (truncated)'. In the NCTC 8325 strain sta070 is SAOUHSC_00773 and has amino acid sequence SEQ ID NO: 106 (GI:88194535).

Useful sta070 antigens can elicit an antibody (e.g. when administered to a human) that recognises SEQ ID NO: 106 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 106; and/or (b) comprising a fragment of at least 'n' consecutive amino acids of SEQ ID NO: 106, wherein 'n' is 7 or more (e.g. 8, 10, 12, 14, 16, 18, 20, 25, 30, 35, 40, 50, 60, 70, 80, 90, 100, 150, 200, 250 or more). These sta070 proteins include variants of SEQ ID NO: 106. Preferred fragments of (b) comprise an epitope from SEQ ID NO: 106. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 106 while retaining at least one epitope of SEQ ID NO: 106. The first 24 N-terminal amino acids of SEQ ID NO: 106 can usefully be omitted. Other fragments omit one or more protein domains.

sta071

The 'sta071' antigen is annotated as 'hemolysin'. In the NCTC 8325 strain sta071 is SAOUHSC_00854 and has amino acid sequence SEQ ID NO: 107 (GI:88194612).

Useful sta071 antigens can elicit an antibody (e.g. when administered to a human) that recognises SEQ ID NO: 107 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 107; and/or (b) comprising a fragment of at least 'n' consecutive amino acids of SEQ ID NO: 107, wherein 'n' is 7 or more (e.g. 8, 10, 12, 14, 16, 18, 20, 25, 30, 35, 40, 50, 60, 70, 80, 90, 100, 150, 200, 250 or more). These sta071 proteins include variants of SEQ ID NO: 107. Preferred fragments of (b) comprise an epitope from SEQ ID NO: 107. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 107 while retaining at least one epitope of SEQ ID NO: 107. The first 24 N-terminal amino acids of SEQ ID NO: 107 can usefully be omitted. Other fragments omit one or more protein domains.

sta072

The 'sta072' antigen is annotated as 'extramembranal protein'. In the NCTC 8325 strain sta072 is SAOUHSC_00872 and has amino acid sequence SEQ ID NO: 108 (GI: 88194629).

Useful sta072 antigens can elicit an antibody (e.g. when administered to a human) that recognises SEQ ID NO: 108 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 108; and/or (b) comprising a fragment of at least 'n' consecutive amino acids of SEQ ID NO: 108, wherein 'n' is 7 or more (e.g. 8, 10, 12, 14, 16, 18, 20, 25, 30, 35, 40, 50, 60, 70, 80, 90, 100, 150, 200, 250 or more). These sta072 proteins include variants of SEQ ID NO: 108. Preferred fragments of (b) comprise an epitope from SEQ ID NO: 108. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 108 while retaining at least one epitope of SEQ ID NO: 108. The first 24 N-terminal amino acids of SEQ ID NO: 108 can usefully be omitted. Other fragments omit one or more protein domains.

sta073

The 'sta073' antigen is annotated as 'bifunctional autolysin precursor'. In the NCTC 8325 strain sta073 is SAOUHSC_00994 and has amino acid sequence SEQ ID NO: 109 (GI: 88194750). In the Newman strain it is nwmn_0922 (GI: 151221134). Proteomic analysis has revealed that this protein is secreted or surface-exposed.

Useful sta073 antigens can elicit an antibody (e.g. when administered to a human) that recognises SEQ ID NO: 109 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 109; and/or (b) comprising a fragment of at least 'n' consecutive amino acids of SEQ ID NO: 109, wherein 'n' is 7 or more (e.g. 8, 10, 12, 14, 16, 18, 20, 25, 30, 35, 40, 50, 60, 70, 80, 90, 100, 150, 200, 250 or more). These sta073 proteins include variants of SEQ ID NO: 109. Preferred fragments of (b) comprise an epitope from SEQ ID NO: 109. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 109 while retaining at least one epitope of SEQ ID NO: 109. The first 24 N-terminal amino acids of SEQ ID NO: 109 can usefully be omitted. Other fragments omit one or more protein domains.

A Sta073 antigen can usefully be included in a composition in combination with a Sta112 [74].

Sta073 does not adsorb well to aluminium hydroxide adjuvants, so Sta073 present in a composition may be unadsorbed or may be adsorbed to an alternative adjuvant e.g. to an aluminium phosphate.

sta074

The 'sta074' antigen is annotated as 'factor essential for methicillin resistance'. In the NCTC 8325 strain sta074 is SAOUHSC_01220 and has amino acid sequence SEQ ID NO: 110 (GI:88194956).

Useful sta074 antigens can elicit an antibody (e.g. when administered to a human) that recognises SEQ ID NO: 110 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 110; and/or (b) comprising a fragment of at least 'n' consecutive amino acids of SEQ ID NO: 110, wherein 'n' is 7 or more (e.g. 8, 10, 12, 14, 16, 18, 20, 25, 30, 35, 40, 50, 60, 70, 80, 90, 100, 150, 200, 250 or more). These sta074 proteins include variants of SEQ ID NO: 110. Preferred fragments of (b) comprise an epitope from SEQ ID NO: 110. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 110 while retaining at least one epitope of SEQ ID NO: 110. Other fragments omit one or more protein domains.

sta075

The 'sta075' antigen is annotated as 'insulysin; peptidase family M16'. In the NCTC 8325 strain sta075 is SAOUHSC_01256 and has amino acid sequence SEQ ID NO: 111 (GI:88194989).

Useful sta075 antigens can elicit an antibody (e.g. when administered to a human) that recognises SEQ ID NO: 111 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 111; and/or (b) comprising a fragment of at least 'n' consecutive amino acids of SEQ ID NO: 111, wherein 'n' is 7 or more (e.g. 8, 10, 12, 14, 16, 18, 20, 25, 30, 35, 40, 50, 60, 70, 80, 90, 100, 150, 200, 250 or more). These sta075 proteins include variants of SEQ ID NO: 111. Preferred fragments of (b) comprise an epitope from SEQ ID NO: 111. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 111 while retaining at least one epitope of SEQ ID NO: 111. Other fragments omit one or more protein domains.

sta076

The 'sta076' antigen is annotated as 'hydrolase'. In the NCTC 8325 strain sta076 is SAOUHSC_01263 and has amino acid sequence SEQ ID NO: 112 (GI:88194996).

Useful sta076 antigens can elicit an antibody (e.g. when administered to a human) that recognises SEQ ID NO: 112 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 112; and/or (b) comprising a fragment of at least 'n' consecutive amino acids of SEQ ID NO: 112, wherein 'n' is 7 or more (e.g. 8, 10, 12, 14, 16, 18, 20, 25, 30, 35, 40, 50, 60, 70, 80, 90, 100, 150, 200, 250 or more). These sta076 proteins include variants of SEQ ID NO: 112. Preferred fragments of (b) comprise an epitope from SEQ ID NO: 112. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 112 while retaining at least one epitope of SEQ ID NO: 112. The first 24 N-terminal amino acids of SEQ ID NO: 112 can usefully be omitted. Other fragments omit one or more protein domains.

sta077

The 'sta077' antigen is annotated as 'protein'. In the NCTC 8325 strain sta077 is SAOUHSC_01317 and has amino acid sequence SEQ ID NO: 113 (GI:88195047). Proteomic analysis has revealed that this protein is secreted or surface-exposed.

Useful sta077 antigens can elicit an antibody (e.g. when administered to a human) that recognises SEQ ID NO: 113 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 113; and/or (b) comprising a fragment of at least 'n' consecutive amino acids of SEQ ID NO: 113, wherein 'n' is 7 or more (e.g. 8, 10, 12, 14, 16, 18, 20, 25, 30, 35, 40, 50, 60, 70, 80, 90, 100, 150, 200, 250 or more). These sta077 proteins include variants of SEQ ID NO: 113. Preferred fragments of (b) comprise an epitope from SEQ ID NO: 113. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 113 while retaining at least one epitope of SEQ ID NO: 113. The first 20 N-terminal amino acids of SEQ ID NO: 113 can usefully be omitted. Other fragments omit one or more protein domains.

sta078

The 'sta078' antigen is annotated as 'FtsK/SpoIIIE family protein'. In the NCTC 8325 strain sta078 is SAOUHSC_01857 and has amino acid sequence SEQ ID NO: 114 (GI: 88195555).

Useful sta078 antigens can elicit an antibody (e.g. when administered to a human) that recognises SEQ ID NO: 114 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 114; and/or (b) comprising a fragment of at least 'n' consecutive amino acids of SEQ ID NO: 114, wherein 'n' is 7 or more (e.g. 8, 10, 12, 14, 16, 18, 20, 25, 30, 35, 40, 50, 60, 70, 80, 90, 100, 150, 200, 250 or more). These sta078 proteins include variants of SEQ ID NO: 114. Preferred fragments of (b) comprise an epitope from SEQ ID NO: 114. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 114 while retaining at least one epitope of SEQ ID NO: 114. Other fragments omit one or more protein domains.

sta079

The 'sta079' antigen is annotated as 'serine protease SplF'. In the NCTC 8325 strain sta079 is SAOUHSC_01935 and has amino acid sequence SEQ ID NO: 115 (GI:88195630).

Useful sta079 antigens can elicit an antibody (e.g. when administered to a human) that recognises SEQ ID NO: 115 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 115; and/or (b) comprising a fragment of at least 'n' consecutive amino acids of SEQ ID NO: 115, wherein 'n' is 7 or more (e.g. 8, 10, 12, 14, 16, 18, 20, 25, 30, 35, 40, 50, 60, 70, 80, 90, 100, 150, 200 or more). These sta079 proteins include variants of SEQ ID NO: 115. Preferred fragments of (b) comprise an epitope from SEQ ID NO: 115. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 115 while retaining at least one epitope of SEQ ID NO: 115. The first 36 N-terminal amino acids of SEQ ID NO: 115 can usefully be omitted. Other fragments omit one or more protein domains.

sta080

The 'sta080' antigen is annotated as 'serine protease SplE'. In the NCTC 8325 strain sta080 is SAOUHSC_01936 and has amino acid sequence SEQ ID NO: 116 (GI:88195631).

Useful sta080 antigens can elicit an antibody (e.g. when administered to a human) that recognises SEQ ID NO: 116 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 116; and/or (b) comprising a fragment of at least 'n' consecutive amino acids of SEQ ID NO: 116, wherein 'n' is 7 or more (e.g. 8, 10, 12, 14, 16, 18, 20, 25, 30, 35, 40, 50, 60, 70, 80, 90, 100, 150, 200 or more). These sta080 proteins include variants of SEQ ID NO: 116. Preferred fragments of (b) comprise an epitope from SEQ ID NO: 116. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 116 while retaining at least one epitope of SEQ ID NO: 116. The first 36 N-terminal amino acids of SEQ ID NO: 116 can usefully be omitted. Other fragments omit one or more protein domains.

sta081

The 'sta081' antigen is annotated as 'serine protease SplD (EC:3.4.21.19)'. In the NCTC 8325 strain sta081 is SAOUHSC_01938 and has amino acid sequence SEQ ID NO: 170 (GI:88195633).

Useful sta081 antigens can elicit an antibody (e.g. when administered to a human) that recognises SEQ ID NO: 170 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 170; and/or (b) comprising a fragment of at least 'n' consecutive amino acids of SEQ ID NO: 170, wherein 'n' is 7 or more (e.g. 8, 10, 12, 14, 16, 18, 20, 25, 30, 35, 40, 50, 60, 70, 80, 90, 100, 150, 200 or more). These sta081 proteins include variants of SEQ ID NO: 170. Preferred fragments of (b) comprise an epitope from SEQ ID NO: 170. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 170 while retaining at least one epitope of SEQ ID NO: 170. The first 36 N-terminal amino acids of SEQ ID NO: 170 can usefully be omitted. Other fragments omit one or more protein domains.

sta082

The 'sta082' antigen is annotated as 'serine protease SplC'. In the NCTC 8325 strain sta082 is SAOUHSC_01939 and has amino acid sequence SEQ ID NO: 117 (GI: 88195634).

Useful sta082 antigens can elicit an antibody (e.g. when administered to a human) that recognises SEQ ID NO: 117 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 117; and/or (b) comprising a fragment of at least 'n' consecutive amino acids of SEQ ID NO: 117, wherein 'n' is 7 or more (e.g. 8, 10, 12, 14, 16, 18, 20, 25, 30, 35, 40, 50, 60, 70, 80, 90, 100, 150, 200 or more). These sta082 proteins include variants of SEQ ID NO: 117. Preferred fragments of (b) comprise an epitope from SEQ ID NO: 117. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 117 while retaining at least one epitope of SEQ ID NO: 117. The first 36 N-terminal amino acids of SEQ ID NO: 117 can usefully be omitted. Other fragments omit one or more protein domains.

sta083

The 'sta083' antigen is annotated as 'serine protease Sp1B'. In the NCTC 8325 strain sta083 is SAOUHSC_01941 and has amino acid sequence SEQ ID NO: 118 (GI: 88195635).

Useful sta083 antigens can elicit an antibody (e.g. when administered to a human) that recognises SEQ ID NO: 118 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 118; and/or (b) comprising a fragment of at least 'n' consecutive amino acids of SEQ ID NO: 118, wherein 'n' is 7 or more (e.g. 8, 10, 12, 14, 16, 18, 20, 25, 30, 35, 40, 50, 60, 70, 80, 90, 100, 150, 200 or more). These sta083 proteins include variants of SEQ ID NO: 118. Preferred fragments of (b) comprise an epitope from SEQ ID NO: 118. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 118 while retaining at least one epitope of SEQ ID NO: 118. The first 36 N-terminal amino acids of SEQ ID NO: 118 can usefully be omitted. Other fragments omit one or more protein domains.

sta084

The 'sta084' antigen is annotated as 'serine protease SpIA'. In the NCTC 8325 strain sta084 is SAOUHSC_01942 and has amino acid sequence SEQ ID NO: 119 (GI:88195636).

Useful sta084 antigens can elicit an antibody (e.g. when administered to a human) that recognises SEQ ID NO: 119 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 119; and/or (b) comprising a fragment of at least 'n' consecutive amino acids of SEQ ID NO: 119, wherein 'n' is 7 or more (e.g. 8, 10, 12, 14, 16, 18, 20, 25, 30, 35, 40, 50, 60, 70, 80, 90, 100, 150, 200 or more). These sta084 proteins include variants of SEQ ID NO: 119. Preferred fragments of (b) comprise an epitope from SEQ ID NO: 119. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 119 while retaining at least one epitope of SEQ ID NO: 119. The first 35 N-terminal amino acids of SEQ ID NO: 119 can usefully be omitted. Other fragments omit one or more protein domains.

sta085

The 'sta085' antigen is annotated as 'staphylokinase precursor'. In the NCTC 8325 strain sta085 is SAOUHSC_02171 and has amino acid sequence SEQ ID NO: 120 (GI: 88195848).

Useful sta085 antigens can elicit an antibody (e.g. when administered to a human) that recognises SEQ ID NO: 120 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 120; and/or (b) comprising a fragment of at least 'n' consecutive amino acids of SEQ ID NO: 120, wherein 'n' is 7 or more (e.g. 8, 10, 12, 14, 16, 18, 20, 25, 30, 35, 40, 50, 60, 70, 80, 90, 100, 150 or more). These sta085 proteins include variants of SEQ ID NO: 120. Preferred fragments of (b) comprise an epitope from SEQ ID NO: 120. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 120 while retaining at least one epitope of SEQ ID NO: 120. The first 27 N-terminal amino acids of SEQ ID NO: 120 can usefully be omitted. Other fragments omit one or more protein domains.

sta086

The 'sta086' antigen is annotated as 'OxaA-like protein'. In the NCTC 8325 strain sta086 is SAOUHSC_02327 and has amino acid sequence SEQ ID NO: 121 (GI:88195993).

Useful sta086 antigens can elicit an antibody (e.g. when administered to a human) that recognises SEQ ID NO: 121 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 121; and/or (b) comprising a fragment of at least 'n' consecutive amino acids of SEQ ID NO: 121, wherein 'n' is 7 or more (e.g. 8, 10, 12, 14, 16, 18, 20, 25, 30, 35, 40, 50, 60, 70, 80, 90, 100, 150, 200, 250 or more). These sta086 proteins include variants of SEQ ID NO: 121. Preferred fragments of (b) comprise an epitope from SEQ ID NO: 121. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 121 while retaining at least one epitope of SEQ ID NO: 121. The first 19 N-terminal amino acids of SEQ ID NO: 121 can usefully be omitted. Other fragments omit one or more protein domains.

sta087

The 'sta087' antigen is annotated as 'teicoplanin resistance protein TcaA'. In the NCTC 8325 strain sta087 is SAOUHSC_02635 and has amino acid sequence SEQ ID NO: 122 (GI:88196276).

Useful sta087 antigens can elicit an antibody (e.g. when administered to a human) that recognises SEQ ID NO: 122 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 122; and/or (b) comprising a fragment of at least 'n' consecutive amino acids of SEQ ID NO: 122, wherein 'n' is 7 or more (e.g. 8, 10, 12, 14, 16, 18, 20, 25, 30, 35, 40, 50, 60, 70, 80, 90, 100, 150, 200, 250 or more). These sta087 proteins include variants of SEQ ID NO: 122. Preferred fragments of (b) comprise an epitope from SEQ ID NO: 122. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 122 while retaining at least one epitope of SEQ ID NO: 122. Other fragments omit one or more protein domains.

sta088

The 'sta088' antigen is annotated as 'esterase'. In the NCTC 8325 strain sta088 is SAOUHSC_02844 and has amino acid sequence SEQ ID NO: 123 (GI:88196477).

Useful sta088 antigens can elicit an antibody (e.g. when administered to a human) that recognises SEQ ID NO: 123 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 123; and/or (b) comprising a fragment of at least 'n' consecutive amino acids of SEQ ID NO: 123, wherein 'n' is 7 or more (e.g. 8, 10, 12, 14, 16, 18, 20, 25, 30, 35, 40, 50, 60, 70, 80, 90, 100, 150, 200, 250 or more). These sta088 proteins include variants of SEQ ID NO: 123. Preferred fragments of (b) comprise an epitope from SEQ ID NO: 123. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 123 while retaining at least one epitope of SEQ ID NO: 123. The first 18 N-terminal amino acids of SEQ ID NO: 123 can usefully be omitted. Other fragments omit one or more protein domains.

sta089

The 'sta089' antigen is annotated as 'LysM domain protein'. In the NCTC 8325 strain sta089 is SAOUHSC_02855 and has amino acid sequence SEQ ID NO: 124 (GI: 88196486).

Useful sta089 antigens can elicit an antibody (e.g. when administered to a human) that recognises SEQ ID NO: 124 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 124; and/or (b) comprising a fragment of at least 'n' consecutive amino acids of SEQ ID NO: 124, wherein 'n' is 7 or more (e.g. 8, 10, 12, 14, 16, 18, 20, 25, 30, 35, 40, 50, 60, 70, 80, 90, 100 or more). These sta089 proteins include variants of SEQ ID NO: 124. Preferred fragments of (b) comprise an epitope from SEQ ID NO: 124. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 124 while retaining at least one epitope of SEQ ID NO: 124. The first 20 N-terminal amino acids of SEQ ID NO: 124 can usefully be omitted. Other fragments omit one or more protein domains.

sta090

The 'sta090' antigen is annotated as 'LysM domain protein'. In the NCTC 8325 strain sta090 is SAOUHSC_02883 and has amino acid sequence SEQ ID NO: 125 (GI: 88196512).

Useful sta090 antigens can elicit an antibody (e.g. when administered to a human) that recognises SEQ ID NO: 125 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 125; and/or (b) comprising a fragment of at least 'n' consecutive amino acids of SEQ ID NO: 125, wherein 'n' is 7 or more (e.g. 8, 10, 12, 14, 16, 18, 20, 25, 30, 35, 40, 50, 60, 70, 80, 90, 100, 150, 200, 250 or more). These sta090 proteins include variants of SEQ ID NO: 125. Preferred fragments of (b) comprise an epitope from SEQ ID NO: 125. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 125 while retaining at least one epitope of SEQ ID NO: 125. The first 26 N-terminal amino acids of SEQ ID NO: 125 can usefully be omitted. Other fragments omit one or more protein domains.

sta091

The 'sta091' antigen is annotated as 'lipoprotein'. In the NCTC 8325 strain sta091 is SAOUHSC_00685 and has amino acid sequence SEQ ID NO: 126 (GI:88194450).

Useful sta091 antigens can elicit an antibody (e.g. when administered to a human) that recognises SEQ ID NO: 126 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 126; and/or (b) comprising a fragment of at least 'n' consecutive amino acids of SEQ ID NO: 126, wherein 'n' is 7 or more (e.g. 8, 10, 12, 14, 16, 18, 20, 25, 30, 35, 40, 50, 60, 70, 80, 90, 100 or more). These sta091 proteins include variants of SEQ ID NO: 126. Preferred fragments of (b) comprise an epitope from SEQ ID NO: 126. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 126 while retaining at least one epitope of SEQ ID NO: 126. The first 15 N-terminal amino acids of SEQ ID NO: 126 can usefully be omitted. Other fragments omit one or more protein domains.

sta092

The 'sta092' antigen is annotated as 'M23/M37 peptidase domain protein'. In the NCTC 8325 strain sta092 is SAOUHSC_00174 and has amino acid sequence SEQ ID NO: 127 (GI:88193984).

Useful sta092 antigens can elicit an antibody (e.g. when administered to a human) that recognises SEQ ID NO: 127 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 127; and/or (b) comprising a fragment of at least 'n' consecutive amino acids of SEQ ID NO: 127, wherein 'n' is 7 or more (e.g. 8, 10, 12, 14, 16, 18, 20, 25, 30, 35, 40, 50, 60, 70, 80, 90, 100, 150 or more). These sta092 proteins include variants of SEQ ID NO: 127. Preferred fragments of (b) comprise an epitope from SEQ ID NO: 127. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 127 while retaining at least one epitope of SEQ ID NO: 127. The first 25 N-terminal amino acids of SEQ ID NO: 127 can usefully be omitted. Other fragments omit one or more protein domains.

sta093

The 'sta093' antigen is annotated as 'protein'. In the NCTC 8325 strain sta093 is SAOUHSC_01854 and has amino acid sequence SEQ ID NO: 128 (GI:88195552).

Useful sta093 antigens can elicit an antibody (e.g. when administered to a human) that recognises SEQ ID NO: 128 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 128; and/or (b) comprising a fragment of at least 'n' consecutive amino acids of SEQ ID NO: 128, wherein 'n' is 7 or more (e.g. 8, 10, 12, 14, 16, 18, 20, 25, 30, 35, 40, 50, 60, 70, 80, 90, 100, 150, 200, 250 or more). These sta093 proteins include variants of SEQ ID NO: 128. Preferred fragments of (b) comprise an epitope from SEQ ID NO: 128. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 128 while retaining at least one epitope of SEQ ID NO: 128. Other fragments omit one or more protein domains.

sta094

The 'sta094' antigen is annotated as 'protein'. In the NCTC 8325 strain sta094 is SAOUHSC_01512 and has amino acid sequence SEQ ID NO: 129 (GI:88195226).

Useful sta094 antigens can elicit an antibody (e.g. when administered to a human) that recognises SEQ ID NO: 129 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 129; and/or (b) comprising a fragment of at least 'n' consecutive amino acids of SEQ ID NO: 129, wherein 'n' is 7 or more (e.g. 8, 10, 12, 14, 16, 18, 20, 25, 30, 35, 40, 50, 60, 70, 80, 90, 100, 150, 200, 250 or more). These sta094 proteins include variants of SEQ ID NO: 129. Preferred fragments of (b) comprise an epitope from SEQ ID NO: 129. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 129 while retaining at least one epitope of SEQ ID NO: 129. The first 17 N-terminal amino acids of SEQ ID NO: 129 can usefully be omitted. Other fragments omit one or more protein domains.

sta095

The 'sta095' antigen is annotated as 'superantigen-like protein'. In the NCTC 8325 strain sta095 is SAOUHSC_00383 and has amino acid sequence SEQ ID NO: 130 (GI: 88194180). In the Newman strain it is nwmn_0388 (GI: 151220600).

Useful sta095 antigens can elicit an antibody (e.g. when administered to a human) that recognises SEQ ID NO: 130 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 130; and/or (b) comprising a fragment of at least 'n' consecutive amino acids of SEQ ID NO: 130, wherein 'n' is 7 or more (e.g. 8, 10, 12, 14, 16, 18, 20, 25, 30, 35, 40, 50, 60, 70, 80, 90, 100, 150, 200 or more). These sta095 proteins include variants of SEQ ID NO: 130. Preferred fragments of (b) comprise an epitope from SEQ ID NO: 130. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 130 while retaining at least one epitope of SEQ ID NO: 130. The first 32 N-terminal amino acids of SEQ ID NO: 130 can usefully be omitted. Other fragments omit one or more protein domains.

sta096

The 'sta096' antigen is annotated as 'superantigen-like protein'. In the NCTC 8325 strain sta096 is SAOUHSC_00384 and has amino acid sequence SEQ ID NO: 131 (GI: 88194181).

Useful sta096 antigens can elicit an antibody (e.g. when administered to a human) that recognises SEQ ID NO: 131 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 131; and/or (b) comprising a fragment of at least 'n' consecutive amino acids of SEQ ID NO: 131, wherein 'n' is 7 or more (e.g. 8, 10, 12, 14, 16, 18, 20, 25, 30, 35, 40, 50, 60, 70, 80, 90, 100, 150, 200 or more). These sta096 proteins include variants of SEQ ID NO: 131. Preferred fragments of (b) comprise an epitope from SEQ ID NO: 131. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 131 while retaining at least one epitope of SEQ ID NO: 131. The first 30 N-terminal amino acids of SEQ ID NO: 131 can usefully be omitted. Other fragments omit one or more protein domains.

sta097

The 'sta097' antigen is annotated as 'superantigen-like protein'. In the NCTC 8325 strain sta097 is SAOUHSC_00386 and has amino acid sequence SEQ ID NO: 132 (GI: 88194182).

Useful sta097 antigens can elicit an antibody (e.g. when administered to a human) that recognises SEQ ID NO: 132 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 132; and/or (b) comprising a fragment of at least 'n' consecutive amino acids of SEQ ID NO: 132, wherein 'n' is 7 or more (e.g. 8, 10, 12, 14, 16, 18, 20, 25, 30, 35, 40, 50, 60, 70, 80, 90, 100, 150, 200, 250 or more). These sta097 proteins include variants of SEQ ID NO: 132. Preferred fragments of (b) comprise an epitope from SEQ ID NO: 132. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 132 while retaining at least one epitope of SEQ ID NO: 132. The first 30 N-terminal amino acids of SEQ ID NO: 132 can usefully be omitted. Other fragments omit one or more protein domains.

sta098

The 'sta098' antigen is annotated as 'superantigen-like protein'. In the NCTC 8325 strain sta098 is SAOUHSC_00389 and has amino acid sequence SEQ ID NO: 133 (GI: 88194184). In the Newman strain it is nwmn_0391 (GI: 151220603).

Useful sta098 antigens can elicit an antibody (e.g. when administered to a human) that recognises SEQ ID NO: 133 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 133; and/or (b) comprising a fragment of at least 'n' consecutive amino acids of SEQ ID NO: 133, wherein 'n' is 7 or more (e.g. 8, 10, 12, 14, 16, 18, 20, 25, 30, 35, 40, 50, 60, 70, 80, 90, 100, 150, 200, 250 or more). These sta098 proteins include variants of SEQ ID NO: 133. Preferred fragments of (b) comprise an epitope from SEQ ID NO: 133. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 133 while retaining at least one epitope of SEQ ID NO: 133. The first 30 N-terminal amino acids of SEQ ID NO: 133 can usefully be omitted. Other fragments omit one or more protein domains.

sta099

The 'sta099' antigen is annotated as 'superantigen-like protein 5'. In the NCTC 8325 strain sta099 is SAOUHSC_00390 and has amino acid sequence SEQ ID NO: 134 (GI: 88194185).

Useful sta099 antigens can elicit an antibody (e.g. when administered to a human) that recognises SEQ ID NO: 134 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 134; and/or (b) comprising a fragment of at least 'n' consecutive amino acids of SEQ ID NO: 134, wherein 'n' is 7 or more (e.g. 8, 10, 12, 14, 16, 18, 20, 25, 30, 35, 40, 50, 60, 70, 80, 90, 100, 150, 200 or more). These sta099 proteins include variants of SEQ ID NO: 134. Preferred fragments of (b) comprise an epitope from SEQ ID NO: 134. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 134 while retaining at least one epitope of SEQ ID NO: 134. The first 30 N-terminal amino acids of SEQ ID NO: 134 can usefully be omitted. Other fragments omit one or more protein domains.

sta100

The 'sta100' antigen is annotated as 'superantigen-like protein'. In the NCTC 8325 strain sta100 is SAOUHSC_00391 and has amino acid sequence SEQ ID NO: 135 (GI: 88194186).

Useful sta100 antigens can elicit an antibody (e.g. when administered to a human) that recognises SEQ ID NO: 135 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 135; and/or (b) comprising a fragment of at least 'n' consecutive amino acids of SEQ ID NO: 135, wherein 'n' is 7 or more (e.g. 8, 10, 12, 14, 16, 18, 20, 25, 30, 35, 40, 50, 60, 70, 80, 90, 100, 150, 200 or more). These sta100 proteins include variants of SEQ ID NO: 135. Preferred fragments of (b) comprise an epitope from SEQ ID NO: 135. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 135 while retaining at least one epitope of SEQ ID NO: 135. The first 30 N-terminal amino acids of SEQ ID NO: 135 can usefully be omitted. Other fragments omit one or more protein domains.

sta101

The 'sta101' antigen is annotated as 'superantigen-like protein 7'. In the NCTC 8325 strain sta101 is SAOUHSC_00392 and has amino acid sequence SEQ ID NO: 136 (GI: 88194187). In the Newman strain it is nwmn_0394 (GI: 151220606).

Useful sta101 antigens can elicit an antibody (e.g. when administered to a human) that recognises SEQ ID NO: 136 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 136; and/or (b) comprising a fragment of at least 'n' consecutive amino acids of SEQ ID NO: 136, wherein 'n' is 7 or more (e.g. 8, 10, 12, 14, 16, 18, 20, 25, 30, 35, 40, 50, 60, 70, 80, 90, 100, 150, 200 or more). These sta101 proteins include variants of SEQ ID NO: 136. Preferred fragments of (b) comprise an epitope from SEQ ID NO: 136. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 136 while retaining at least one epitope of SEQ ID NO: 136. The first 30 N-terminal amino acids of SEQ ID NO: 136 can usefully be omitted. Other fragments omit one or more protein domains.

sta102

The 'sta102' antigen is annotated as 'superantigen-like protein'. In the NCTC 8325 strain sta102 is SAOUHSC_00393 and has amino acid sequence SEQ ID NO: 137 (GI: 88194188).

Useful sta102 antigens can elicit an antibody (e.g. when administered to a human) that recognises SEQ ID NO: 137 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 137; and/or (b) comprising a fragment of at least 'n' consecutive amino acids of SEQ ID NO: 137, wherein 'n' is 7 or more (e.g. 8, 10, 12, 14, 16, 18, 20, 25, 30, 35, 40, 50, 60, 70, 80, 90, 100, 150, 200 or more). These sta102 proteins include variants of SEQ ID NO: 137. Preferred fragments of (b) comprise an epitope from SEQ ID NO: 137. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 137 while retaining at least one epitope of SEQ ID NO: 137. The first 17 N-terminal amino acids of SEQ ID NO: 137 can usefully be omitted. Other fragments omit one or more protein domains.

sta103

The 'sta103' antigen is annotated as 'superantigen-like protein'. In the NCTC 8325 strain sta103 is SAOUHSC_00394 and has amino acid sequence SEQ ID NO: 138 (GI: 88194189).

Useful sta103 antigens can elicit an antibody (e.g. when administered to a human) that recognises SEQ ID NO: 138 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 138; and/or (b) comprising a fragment of at least 'n' consecutive amino acids of SEQ ID NO: 138, wherein 'n' is 7 or more (e.g. 8, 10, 12, 14, 16, 18, 20, 25, 30, 35, 40, 50, 60, 70, 80, 90, 100, 150, 200 or more). These sta103 proteins include variants of SEQ ID NO: 138. Preferred fragments of (b) comprise an epitope from SEQ ID NO: 138. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 138 while retaining at least one epitope of SEQ ID NO: 138. The first 23 N-terminal amino acids of SEQ ID NO: 138 can usefully be omitted. Other fragments omit one or more protein domains.

sta104

The 'sta104' antigen is annotated as 'superantigen-like protein'. In the NCTC 8325 strain sta104 is SAOUHSC_00395 and has amino acid sequence SEQ ID NO: 139 (GI: 88194190).

Useful sta104 antigens can elicit an antibody (e.g. when administered to a human) that recognises SEQ ID NO: 139 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 139; and/or (b) comprising a fragment of at least 'n' consecutive amino acids of SEQ ID NO: 139, wherein 'n' is 7 or more (e.g. 8, 10, 12, 14, 16, 18, 20, 25, 30, 35, 40, 50, 60, 70, 80, 90, 100, 150, 200 or more). These sta104 proteins include variants of SEQ ID NO: 139. Preferred fragments of (b) comprise an epitope from SEQ ID NO: 139. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 139 while retaining at least one epitope of SEQ ID NO: 139. Other fragments omit one or more protein domains.

sta105

The 'sta105' antigen is annotated as 'superantigen-like protein'. In the NCTC 8325 strain sta105 is SAOUHSC_00399 and has amino acid sequence SEQ ID NO: 140 (GI: 88194194). In the Newman strain it is nwmn_0400 (GI: 151220612).

Useful sta105 antigens can elicit an antibody (e.g. when administered to a human) that recognises SEQ ID NO: 140 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 140; and/or (b) comprising a fragment of at least 'n' consecutive amino acids of SEQ ID NO: 140, wherein 'n' is 7 or more (e.g. 8, 10, 12, 14, 16, 18, 20, 25, 30, 35, 40, 50, 60, 70, 80, 90, 100, 150, 200 or more). These sta105 proteins include variants of SEQ ID NO: 140. Preferred fragments of (b) comprise an epitope from SEQ ID NO: 140. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 140 while retaining at least one epitope of SEQ ID NO: 140. The first 30 N-terminal amino acids of SEQ ID NO: 140 can usefully be omitted. Other fragments omit one or more protein domains.

sta106

The 'sta106' antigen is annotated as 'hypothetical protein'. In the NCTC 8325 strain sta106 is SAOUHSC_01115 and has amino acid sequence SEQ ID NO: 141 (GI:88194861).

Useful sta106 antigens can elicit an antibody (e.g. when administered to a human) that recognises SEQ ID NO: 141 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 141; and/or (b) comprising a fragment of at least 'n' consecutive amino acids of SEQ ID NO: 141, wherein 'n' is 7 or more (e.g. 8, 10, 12, 14, 16, 18, 20, 25, 30, 35, 40, 50, 60, 70, 80, 90, 100 or more). These sta106 proteins include variants of SEQ ID NO: 141. Preferred fragments of (b) comprise an epitope from SEQ ID NO: 141. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 141 while retaining at least one epitope of SEQ ID NO: 141. The first 16 N-terminal amino acids of SEQ ID NO: 141 can usefully be omitted. Other fragments omit one or more protein domains.

sta107

The 'sta107' antigen is annotated as 'hypothetical protein'. In the NCTC 8325 strain sta107 is SAOUHSC_00354 and has amino acid sequence SEQ ID NO: 177 (GI:88194153).

Useful sta107 antigens can elicit an antibody (e.g. when administered to a human) that recognises SEQ ID NO: 177 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 177; and/or (b) comprising a fragment of at least 'n' consecutive amino acids of SEQ ID NO: 177, wherein 'n' is 7 or more (e.g. 8, 10, 12, 14, 16, 18, 20, 25, 30, 35, 40, 50, 60, 70, 80, 90, 100, 150, 200 or more). These sta107 proteins include variants of SEQ ID NO: 177. Preferred fragments of (b) comprise an epitope from SEQ ID NO: 177. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 177 while retaining at least one epitope of SEQ ID NO: 177. The first 35 N-terminal amino acids of SEQ ID NO: 177 can usefully be omitted. Other fragments omit one or more protein domains.

sta108

The 'sta108' antigen is annotated as 'hypothetical protein'. In the NCTC 8325 strain sta108 is SAOUHSC_00717 and has amino acid sequence SEQ ID NO: 178 (GI:88194482).

Useful sta108 antigens can elicit an antibody (e.g. when administered to a human) that recognises SEQ ID NO: 178 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 178; and/or (b) comprising a fragment of at least 'n' consecutive amino acids of SEQ ID NO: 178, wherein 'n' is 7 or more (e.g. 8, 10, 12, 14, 16, 18, 20, 25, 30, 35, 40, 50, 60, 70, 80, 90, 100 or more). These sta108 proteins include variants of SEQ ID NO: 178. Preferred fragments of (b) comprise an epitope from SEQ ID NO: 178. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 178 while retaining at least one epitope of SEQ ID NO: 178. The first 20 N-terminal amino acids of SEQ ID NO: 178 can usefully be omitted. Other fragments omit one or more protein domains.

sta109

The 'sta109' antigen is annotated as 'N-acetylmuramoyl-L-alanine amidase'. In the NCTC 8325 strain sta109 is SAOUHSC_02979 and has amino acid sequence SEQ ID NO: 179 (GI:88196599).

Useful sta109 antigens can elicit an antibody (e.g. when administered to a human) that recognises SEQ ID NO: 179 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 179; and/or (b) comprising a fragment of at least 'n' consecutive amino acids of SEQ ID NO: 179, wherein 'n' is 7 or more (e.g. 8, 10, 12, 14, 16, 18, 20, 25, 30, 35, 40, 50, 60, 70, 80, 90, 100, 150, 200, 250 or more). These sta109 proteins include variants of SEQ ID NO: 179. Preferred fragments of (b) comprise an epitope from SEQ ID NO: 179. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 179 while retaining at least one epitope of SEQ ID NO: 179. The first 27 N-terminal amino acids of SEQ ID NO: 179 can usefully be omitted. Other fragments omit one or more protein domains.

sta110

The 'sta110' antigen is annotated as 'hypothetical protein'. In the NCTC 8325 strain sta110 is SAOUHSC_01039 and has amino acid sequence SEQ ID NO: 180 (GI:88194791).

Useful sta110 antigens can elicit an antibody (e.g. when administered to a human) that recognises SEQ ID NO: 180 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 180; and/or (b) comprising a fragment of at least 'n' consecutive amino acids of SEQ ID NO: 180, wherein 'n' is 7 or more (e.g. 8, 10, 12, 14, 16, 18, 20, 25, 30, 35, 40, 50, 60, 70, 80, 90, 100, 150, 200 or more). These sta110 proteins include variants of SEQ ID NO: 180. Preferred fragments of (b) comprise an epitope from SEQ ID NO: 180. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 180 while retaining at least one epitope of SEQ ID NO: 180. The first 19 N-terminal amino acids of SEQ ID NO: 180 can usefully be omitted. Other fragments omit one or more protein domains.

sta111

The 'sta111' antigen is annotated as 'hypothetical protein'. In the NCTC 8325 strain sta111 is SAOUHSC_01005 and has amino acid sequence SEQ ID NO: 181 (GI:88194760).

Useful sta111 antigens can elicit an antibody (e.g. when administered to a human) that recognises SEQ ID NO: 181 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 181; and/or (b) comprising a fragment of at least 'n' consecutive amino acids of SEQ ID NO: 181, wherein 'n' is 7 or more (e.g. 8, 10, 12, 14, 16, 18, 20, 25, 30, 35, 40, 50, 60, 70, 80, 90, 100 or more). These sta111 proteins include variants of SEQ ID NO: 181. Preferred fragments of (b) comprise an epitope from SEQ ID NO: 181. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 181 while retaining at least one epitope of SEQ ID NO: 181. The first 20 N-terminal amino acids of SEQ ID NO: 181 can usefully be omitted. Other fragments omit one or more protein domains.

sta112

The 'sta112' antigen is annotated as a putative 'ABC transporter, substrate-binding protein'. In the NCTC 8325 strain sta112 is SAOUHSC_00634 and has amino acid sequence SEQ ID NO: 182 (GI:88194402).

Useful sta112 antigens can elicit an antibody (e.g. when administered to a human) that recognises SEQ ID NO: 182 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 182; and/or (b) comprising a fragment of at least 'n' consecutive amino acids of SEQ ID NO: 182, wherein 'n' is 7 or more (e.g. 8, 10, 12, 14, 16, 18, 20, 25, 30, 35, 40, 50, 60, 70, 80, 90, 100, 150, 200, 250 or more). These sta112 proteins include variants of SEQ ID NO: 182. Preferred fragments of (b) comprise an epitope from SEQ ID NO: 182. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 182 while retaining at least one epitope of SEQ ID NO: 182. The first 17 N-terminal amino acids of SEQ ID NO: 182 can usefully be omitted. Other fragments omit one or more protein domains.

A Sta112 antigen can usefully be included in a composition in combination with a Sta073 [74].

sta113

The 'sta113' antigen is annotated as 'hypothetical protein'. In the NCTC 8325 strain sta113 is SAOUHSC_00728 and has amino acid sequence SEQ ID NO: 183 (GI:88194493).

Useful sta113 antigens can elicit an antibody (e.g. when administered to a human) that recognises SEQ ID NO: 183 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 183; and/or (b) comprising a fragment of at least 'n' consecutive amino acids of SEQ ID NO: 183, wherein 'n' is 7 or more (e.g. 8, 10, 12, 14, 16, 18, 20, 25, 30, 35, 40, 50, 60, 70, 80, 90, 100, 150, 200, 250 or more). These sta113 proteins include variants of SEQ ID NO: 183. Preferred fragments of (b) comprise an epitope from SEQ ID NO: 183. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 183 while retaining at least one epitope of SEQ ID NO: 183. The first 173 N-terminal amino acids of SEQ ID NO: 183 can usefully be omitted. Other fragments omit one or more protein domains.

sta114

The 'sta114' antigen is annotated as 'hypothetical protein'. In the NCTC 8325 strain sta114 is SAOUHSC_00810 and has amino acid sequence SEQ ID NO: 184 (GI:88194570).

Useful sta114 antigens can elicit an antibody (e.g. when administered to a human) that recognises SEQ ID NO: 184 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 184; and/or (b) comprising a fragment of at least 'n' consecutive amino acids of SEQ ID NO: 184, wherein 'n' is 7 or more (e.g. 8, 10, 12, 14, 16, 18, 20, 25, 30, 35, 40, 50, 60, 70, 80, 90, 100, 150 or more). These sta114 proteins include variants of SEQ ID NO: 184. Preferred fragments of (b) comprise an epitope from SEQ ID NO: 184. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 184 while retaining at least one epitope of SEQ ID NO: 184. Other fragments omit one or more protein domains.

sta115

The 'sta115' antigen is annotated as 'hypothetical protein'. In the NCTC 8325 strain sta115 is SAOUHSC_00817 and has amino acid sequence SEQ ID NO: 185 (GI:88194576).

Useful sta115 antigens can elicit an antibody (e.g. when administered to a human) that recognises SEQ ID NO: 185 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 185; and/or (b) comprising a fragment of at least 'n' consecutive amino acids of SEQ ID NO: 185, wherein 'n' is 7 or more (e.g. 8, 10, 12, 14, 16, 18, 20, 25, 30, 35, 40, 50, 60, 70, 80, 90, 100, 150 or more). These sta115 proteins include variants of SEQ ID NO: 185. Preferred fragments of (b) comprise an epitope from SEQ ID NO: 185. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 185 while retaining at least one epitope of SEQ ID NO: 185. The first 18 N-terminal amino acids of SEQ ID NO: 185 can usefully be omitted. Other fragments omit one or more protein domains.

sta116

The 'sta116' antigen is annotated as 'formyl peptide receptor-like 1 inhibitory protein'. In the NCTC 8325 strain sta116 is SAOUHSC_01112 and has amino acid sequence SEQ ID NO: 186 (GI:88194858).

Useful sta116 antigens can elicit an antibody (e.g. when administered to a human) that recognises SEQ ID NO: 186 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 186; and/or (b) comprising a fragment of at least 'n' consecutive amino acids of SEQ ID NO: 186, wherein 'n' is 7 or more (e.g. 8, 10, 12, 14, 16, 18, 20, 25, 30, 35, 40, 50, 60, 70, 80, 90, 100 or more). These sta116 proteins include variants of SEQ ID NO: 186. Preferred fragments of (b) comprise an epitope from SEQ ID NO: 186. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 186 while retaining at least one epitope of SEQ ID NO: 186. The first 20 N-terminal amino acids of SEQ ID NO: 186 can usefully be omitted. Other fragments omit one or more protein domains.

sta117

The 'sta117' antigen is annotated as 'truncated beta-hemolysin'. In the NCTC 8325 strain sta117 is SAOUHSC_02240 and has amino acid sequence SEQ ID NO: 187 (GI: 88195913).

Useful sta117 antigens can elicit an antibody (e.g. when administered to a human) that recognises SEQ ID NO: 187 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 187; and/or (b) comprising a fragment of at least 'n' consecutive amino acids of SEQ ID NO: 187, wherein 'n' is 7 or more (e.g. 8, 10, 12, 14, 16, 18, 20, 25, 30, 35, 40, 50, 60, 70, 80, 90, 100, 150, 200, 250 or more). These sta117 proteins include variants of SEQ ID NO: 187. Preferred fragments of (b) comprise an epitope from SEQ ID NO: 187. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 187 while retaining at least one epitope of SEQ ID NO: 187. Other fragments omit one or more protein domains.

sta118

The 'sta118' antigen is annotated as 'cell division protein FtsZ'. In the NCTC 8325 strain sta118 is SAOUHSC_01150 and has amino acid sequence SEQ ID NO: 188 (GI: 88194892).

Useful sta118 antigens can elicit an antibody (e.g. when administered to a human) that recognises SEQ ID NO: 188 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 188; and/or (b) comprising a fragment of at least 'n' consecutive amino acids of SEQ ID NO: 188, wherein 'n' is 7 or more (e.g. 8, 10, 12, 14, 16, 18, 20, 25, 30, 35, 40, 50, 60, 70, 80, 90, 100, 150, 200, 250 or more). These sta118 proteins include variants of SEQ ID NO: 188. Preferred fragments of (b) comprise an epitope from SEQ ID NO: 188. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 188 while retaining at least one epitope of SEQ ID NO: 188. Other fragments omit one or more protein domains.

sta119

The 'sta119' antigen is annotated as 'thioredoxin'. In the NCTC 8325 strain sta119 is SAOUHSC_01100 and has amino acid sequence SEQ ID NO: 200 (GI:88194846).

Useful sta119 antigens can elicit an antibody (e.g. when administered to a human) that recognises SEQ ID NO: 200 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 200; and/or (b) comprising a fragment of at least 'n' consecutive amino acids of SEQ ID NO: 200, wherein 'n' is 7 or more (e.g. 8, 10, 12, 14, 16, 18, 20, 25, 30, 35, 40, 50, 60, 70, 80, 90, 100 or more). These sta119 proteins include variants of SEQ ID NO: 200. Preferred fragments of (b) comprise an epitope from SEQ ID NO: 200. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 200 while retaining at least one epitope of SEQ ID NO: 200. Other fragments omit one or more protein domains.

sta120

The 'sta120' antigen is annotated as 'alkyl hydroperoxide reductase subunit C'. In the NCTC 8325 strain sta120 is SAOUHSC_00365 and has amino acid sequence SEQ ID NO: 201 (01:88194163).

Useful sta120 antigens can elicit an antibody (e.g. when administered to a human) that recognises SEQ ID NO: 201 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 201; and/or (b) comprising a fragment of at least 'n' consecutive amino acids of SEQ ID NO: 201, wherein 'n' is 7 or more (e.g. 8, 10, 12, 14, 16, 18, 20, 25, 30, 35, 40, 50, 60, 70, 80, 90, 100, 150 or more). These sta120 proteins include variants of SEQ ID NO: 201. Preferred fragments of (b) comprise an epitope from SEQ ID NO: 201. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 201 while retaining at least one epitope of SEQ ID NO: 201. Other fragments omit one or more protein domains.

NW_6

The 'NW_6' antigen is annotated as 'secreted von Willebrand factor-binding protein precursor'. In the Newman strain NW_6 is NWMN_0757 and has amino acid sequence SEQ ID NO: 142 (GI:151220969).

Useful NW_6 antigens can elicit an antibody (e.g. when administered to a human) that recognises SEQ ID NO: 142 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 142; and/or (b) comprising a fragment of at least 'n' consecutive amino acids of SEQ ID NO: 142, wherein 'n' is 7 or more (e.g. 8, 10, 12, 14, 16, 18, 20, 25, 30, 35, 40, 50, 60, 70, 80, 90, 100, 150, 200, 250 or more). These NW_6 proteins include variants of SEQ ID NO: 142. Preferred fragments of (b) comprise an epitope from SEQ ID NO: 142. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 142 while retaining at least one epitope of SEQ ID NO: 142. The first 13 N-terminal amino acids of SEQ ID NO: 142 can usefully be omitted. Other fragments omit one or more protein domains.

NW_9

The 'NW_9' antigen is annotated as 'lipoprotein'. In the Newman strain NW_9 is NWMN_0958 and has amino acid sequence SEQ ID NO: 143 (GI:151221170).

Useful NW_9 antigens can elicit an antibody (e.g. when administered to a human) that recognises SEQ ID NO: 143 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 143; and/or (b) comprising a fragment of at least 'n' consecutive amino acids of SEQ ID NO: 143, wherein 'n' is 7 or more (e.g. 8, 10, 12, 14, 16, 18, 20, 25, 30, 35, 40, 50, 60, 70, 80, 90, 100, 150, 200 or more). These NW_9 proteins include variants of SEQ ID NO: 143. Preferred fragments of (b) comprise an epitope from SEQ ID NO: 143. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 143 while retaining at least one epitope of SEQ ID NO: 143. The first 19 N-terminal amino acids of SEQ ID NO: 143 can usefully be omitted. Other fragments omit one or more protein domains.

NW_10

The 'NW_10' antigen is annotated as 'fibrinogen binding-related protein'. In the Newman strain NW_10 is NWMN_1066 and has amino acid sequence SEQ ID NO: 144 (GI: 151221278).

Useful NW_10 antigens can elicit an antibody (e.g. when administered to a human) that recognises SEQ ID NO: 144 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 144; and/or (b) comprising a fragment of at least 'n' consecutive amino acids of SEQ ID NO: 144, wherein 'n' is 7 or more (e.g. 8, 10, 12, 14, 16, 18, 20, 25, 30, 35, 40, 50, 60, 70, 80, 90, 100 or more). These NW_10 proteins include variants of SEQ ID NO: 144. Preferred fragments of (b) comprise an epitope from SEQ ID NO: 144. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 144 while retaining at least one epitope of SEQ ID NO: 144. The first 20 N-terminal amino acids of SEQ ID NO: 144 can usefully be omitted. Other fragments omit one or more protein domains.

NW_7

The 'NW_7' antigen is annotated as 'staphylococcal complement inhibitor SCIN'. In the Newman strain NW_7 is NWMN_1876 and has amino acid sequence SEQ ID NO: 145 (GI:151222088).

Useful NW_7 antigens can elicit an antibody (e.g. when administered to a human) that recognises SEQ ID NO: 145 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 145; and/or (b) comprising a fragment of at least 'n' consecutive amino acids of SEQ ID NO: 145, wherein 'n' is 7 or more (e.g. 8, 10, 12, 14, 16, 18, 20, 25, 30, 35, 40, 50, 60, 70, 80, 90, 100 or more). These NW_7 proteins include variants of SEQ ID NO: 145. Preferred fragments of (b) comprise an epitope from SEQ ID NO: 145. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 145 while retaining at least one epitope of SEQ ID NO: 145. The first 17 N-terminal amino acids of SEQ ID NO: 145 can usefully be omitted. Other fragments omit one or more protein domains.

NW_8

The 'NW_8' antigen is annotated as 'chemotaxis-inhibiting protein CHIPS'. In the Newman strain NW_8 is NWMN_1877 and has amino acid sequence SEQ ID NO: 146 (GI:151222089).

Useful NW_8 antigens can elicit an antibody (e.g. when administered to a human) that recognises SEQ ID NO: 146 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 146; and/or (b) comprising a fragment of at least 'n' consecutive amino acids of SEQ ID NO: 146, wherein 'n' is 7 or more (e.g. 8, 10, 12, 14, 16, 18, 20, 25, 30, 35, 40, 50, 60, 70, 80, 90, 100 or more). These NW_8 proteins include variants of SEQ ID NO: 146. Preferred fragments of (b) comprise an epitope from SEQ ID NO: 146. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 146 while retaining at least one epitope of SEQ ID NO: 146. The first 19 N-terminal amino acids of SEQ ID NO: 146 can usefully be omitted. Other fragments omit one or more protein domains.

NW_2

The 'NW_2' antigen is annotated as 'enterotoxin type A precursor'. In the Newman strain NW_2 is NWMN_1883 and has amino acid sequence SEQ ID NO: 147 (GI: 151222095).

Useful NW_2 antigens can elicit an antibody (e.g. when administered to a human) that recognises SEQ ID NO: 147 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 147; and/or (b) comprising a fragment of at least 'n' consecutive amino acids of SEQ ID NO: 147, wherein 'n' is 7 or more (e.g. 8, 10, 12, 14, 16, 18, 20, 25, 30, 35, 40, 50, 60, 70, 80, 90, 100, 150, 200, 250 or more). These NW_2 proteins include variants of SEQ ID NO: 147. Preferred fragments of (b) comprise an epitope from SEQ ID NO: 147. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 147 while retaining at least one epitope of SEQ ID NO: 147. The first 16 N-terminal amino acids of SEQ ID NO: 147 can usefully be omitted. Other fragments omit one or more protein domains.

NW_1

The 'NW_1' antigen is annotated as 'lipoprotein'. In the Newman strain NW_1 is NWMN_1924 and has amino acid sequence SEQ ID NO: 148 (GI:151222136).

Useful NW_1 antigens can elicit an antibody (e.g. when administered to a human) that recognises SEQ ID NO: 148 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 148; and/or (b) comprising a fragment of at least 'n' consecutive amino acids of SEQ ID NO: 148, wherein 'n' is 7 or more (e.g. 8, 10, 12, 14, 16, 18, 20, 25, 30, 35, 40, 50, 60, 70, 80, 90, 100, 150 or more). These NW_1 proteins include variants of SEQ ID NO: 148. Preferred fragments of (b) comprise an epitope from SEQ ID NO: 148. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 148 while retaining at least one epitope of SEQ ID NO: 148. The first 17 N-terminal amino acids of SEQ ID NO: 148 can usefully be omitted. Other fragments omit one or more protein domains.

NW_5

The 'NW_5' antigen is annotated as 'cell wall surface anchor family protein'. In the Newman strain NW_5 is NWMN_2392 and has amino acid sequence SEQ ID NO: 149 (GI:151222604).

Useful NW_5 antigens can elicit an antibody (e.g. when administered to a human) that recognises SEQ ID NO: 149 and/or may comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 149; and/or (b) comprising a fragment of at least 'n' consecutive amino acids of SEQ ID NO: 149, wherein 'n' is 7 or more (e.g. 8, 10, 12, 14, 16, 18, 20, 25, 30, 35, 40, 50, 60, 70, 80, 90, 100, 150, 200, 250 or more). These NWS proteins include variants of SEQ ID NO: 149. Preferred fragments of (b) comprise an epitope from SEQ ID NO: 149. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 149 while retaining at least one epitope of SEQ ID NO: 149. The first 52 N-terminal amino acids of SEQ ID NO: 149 can usefully be omitted. Other fragments omit one or more protein domains.

Hybrid Polypeptides

Antigens used in the invention may be present in the composition as individual separate polypeptides. Where more than one antigen is used, however, they do not have to be present as separate polypeptides. Instead, at least two (e.g. 2, 3, 4, 5, or more) antigens can be expressed as a single polypeptide chain (a 'hybrid' polypeptide). Hybrid polypeptides offer two main advantages: first, a polypeptide that may be unstable or poorly expressed on its own can be assisted by adding a suitable hybrid partner that overcomes the problem; second, commercial manufacture is simplified as only one expression and purification need be employed in order to produce two polypeptides which are both antigenically useful.

The hybrid polypeptide may comprise two or more polypeptide sequences from the first antigen group. The hybrid polypeptide may comprise one or more polypeptide sequences from the first antigen group and one or more polypeptide sequences from the second antigen group. Moreover, the hybrid polypeptide may comprise two or more polypeptide sequences from each of the antigens listed above, or two or more variants of the same antigen in the cases in which the sequence has partial variability across strains.

Hybrids consisting of amino acid sequences from two, three, four, five, six, seven, eight, nine, or ten antigens are useful. In particular, hybrids consisting of amino acid sequences from two, three, four, or five antigens are preferred, such as two or three antigens.

Different hybrid polypeptides may be mixed together in a single formulation. Hybrids may be combined with non-hybrid antigens selected from the first, second or third antigen groups. Within such combinations, an antigen may be present in more than one hybrid polypeptide and/or as a non-hybrid polypeptide. It is preferred, however, that an antigen is present either as a hybrid or as a non-hybrid, but not as both.

The hybrid polypeptides can also be combined with conjugates or non-*S. aureus* antigens as described above.

Hybrid polypeptides can be represented by the formula $NH_2$-A-{-X-L-}$_n$-B—COOH, wherein: X is an amino acid sequence of a *S. aureus* antigen, as described above; L is an optional linker amino acid sequence; A is an optional N-terminal amino acid sequence; B is an optional C-terminal amino acid sequence; n is an integer of 2 or more (e.g. 2, 3, 4, 5, 6, etc.). Usually n is 2 or 3.

If a —X— moiety has a leader peptide sequence in its wild-type form, this may be included or omitted in the hybrid protein. In some embodiments, the leader peptides will be deleted except for that of the —X— moiety located at the N-terminus of the hybrid protein i.e. the leader peptide of $X_1$ will be retained, but the leader peptides of $X_2 \ldots X_n$ will be omitted. This is equivalent to deleting all leader peptides and using the leader peptide of $X_1$ as moiety -A-.

For each n instances of {—X-L-}, linker amino acid sequence -L- may be present or absent. For instance, when n=2 the hybrid may be $NH_2$—$X_1$-$L_1$-$X_2$-$L_2$-COOH, $NH_2$—$X_1$—$X_2$—COOH, $NH_2$—$X_1$-$L_1$$X_2$—COOH, $NH_2$—$X_1$—$X_2$-$L_2$-COOH, etc. Linker amino acid sequence(s) -L- will typically be short (e.g. 20 or fewer amino acids i.e. 20, 19, 18, 17, 16, 15, 14, 13, 12, 11, 10, 9, 8, 7, 6, 5, 4, 3, 2, 1). Examples comprise short peptide sequences which facilitate cloning, poly-glycine linkers (i.e. comprising Gly$_n$ where n=2, 3, 4, 5, 6, 7, 8, 9, 10 or more), and histidine tags (i.e. His$_n$ where n=3, 4, 5, 6, 7, 8, 9, 10 or more). Other suitable linker amino acid sequences will be apparent to those skilled in the art. A useful linker is GSGGGG (SEQ ID NO: 171) or GSGSGGGG (SEQ ID NO: 172), with the Gly-Ser dipeptide being formed from a BamHI restriction site (or two of them, to form the SEQ ID NO: 230 tetrapeptide), thus aiding cloning and manipulation, and the (Gly)$_4$ tetrapeptide (SEQ ID NO: 227) being a typical poly-glycine linker. Other suitable linkers, particularly for use as the final $L_n$ are ASGGGS (SEQ ID NO: 173 e.g. encoded by SEQ ID NO: 174) or a Leu-Glu dipeptide.

-A- is an optional N-terminal amino acid sequence. This will typically be short (e.g. 40 or fewer amino acids i.e. 40, 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2, 1). Examples include leader sequences to direct protein trafficking, or short peptide sequences which facilitate cloning or purification (e.g. histidine tags i.e. His$_n$ where n=3, 4, 5, 6, 7, 8, 9, 10 or more). Other suitable N-terminal amino acid sequences will be apparent to those skilled in the art. If $X_1$ lacks its own N-terminus methionine, -A- is preferably an oligopeptide (e.g. with 1, 2, 3, 4, 5, 6, 7 or 8 amino acids) which provides a N-terminus methionine e.g. Met-Ala-Ser, or a single Met residue.

—B— is an optional C-terminal amino acid sequence. This will typically be short (e.g. 40 or fewer amino acids i.e. 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2, 1). Examples include sequences to direct protein trafficking, short peptide sequences which facilitate cloning or purification (e.g. comprising histidine tags i.e. His$_n$ where n=3, 4, 5, 6, 7, 8, 9, 10 or more, such as SEQ ID NO: 226), or sequences which enhance protein stability. Other suitable C-terminal amino acid sequences will be apparent to those skilled in the art.

One hybrid polypeptide of the invention may include both EsxA and EsxB antigens. These may be in either order, N- to C-terminus. SEQ ID NOs: 151 ('EsxAB'; encoded by SEQ ID NO: 169) and 152 ('EsxBA') are examples of such hybrids, both having hexapeptide linkers ASGGGS (SEQ ID NO: 173). Another 'EsxAB' hybrid comprises SEQ ID NO: 241, which may be provided with a N-terminus methionine (e.g. SEQ ID NO: 250).

Another hybrid polypeptide of the invention may include both SdrD and SdrE antigens. These may be in either order, N- to C-terminus. SEQ ID NO: 168 ('SdrED') is an example of such a hybrid, having a hexapeptide linker ASGGGS (SEQ ID NO: 173).

Another hybrid polypeptide of the invention may include both ClfB and SdrD antigens. These may be in either order, N- to C-terminus. SEQ ID NO: 202 ('ClfB-SdrD') is an example of such a hybrid, having a hexapeptide linker ASGGGS (SEQ ID NO: 173). SEQ ID NO: 203 ('SdrD-ClfB') is another example of such a hybrid, having a hexapeptide linker ASGGGS (SEQ ID NO: 173). SEQ ID NO: 211 ('ClfB-N3-sdrD-N3') is another example of such a hybrid, where the N3 fragments of ClfB and SdrD are joined by hexapeptide linker ASGGGS (SEQ ID NO: 173).

Another hybrid polypeptide of the invention may include both IsdA and EsxA antigens. These may be in either order, N- to C-terminus. SEQ ID NO: 204 ('IsdA-EsxA') is an example of such a hybrid, having a hexapeptide linker ASGGGS (SEQ ID NO: 173). SEQ ID NO: 209 ('isdA40-184-esxA') is another example of such a hybrid, in which IsdA$_{40-184}$ is joined to EsxA via linker ASGGGS (SEQ ID NO: 173).

Another hybrid polypeptide of the invention may include both IsdA and sta006 antigens. These may be in either order, N- to C-terminus. SEQ ID NO: 221 ('isdA40-184-sta006') is an example of such a hybrid, in which IsdA$_{40-184}$ is joined to Sta006 via hexapeptide linker ASGGGS (SEQ ID NO: 173).

Another hybrid polypeptide of the invention may include both Hla and sta006 antigens. These may be in either order, N- to C-terminus. SEQ ID NO: 222 ('HlaH35L-sta006') is an example of such a hybrid, in which a H35L mutant of Hla is joined to Sta006 via hexapeptide linker ASGGGS (SEQ ID NO: 173).

Another hybrid polypeptide of the invention may include both Hla and Emp antigens. These may be in either order, N- to C-terminus. SEQ ID NO: 205 ('HlaH35L-Emp') is an example of such a hybrid, in which a H35L mutant Hla is joined to Emp via linker ASGGGS (SEQ ID NO: 173). SEQ ID NO: 206 ('Hla27-76-Emp') is another example of such a hybrid, in which a Hla fragment is joined to Emp via linker ASGGGS (SEQ ID NO: 173); SEQ ID NO: 207 is a H35L mutant of SEQ ID NO: 206. SEQ ID NO: 208 ('HlaPSGS-Emp') is another example of such a hybrid, in which a Hla mutant is joined to Emp via linker ASGGGS (SEQ ID NO: 173).

Another hybrid polypeptide of the invention may include IsdA and EsxA and EsxB antigens. These may be in any order, N- to C-terminus. SEQ ID NO: 210 ('isdA40-184-esxAB') is an example of such a triple hybrid, in which IsdA$_{40-184}$ is joined to EsxAB via linker ASGGGS (SEQ ID NO: 173). The EsxAB already includes the same linker, so SEQ ID NO: 210 includes two of these linkers. SEQ ID NO: 212 ('IsdA-esxAB') is another example of such a triple hybrid, in which IsdA is joined to EsxAB via linker ASGGGS (SEQ ID NO: 173).

Another hybrid polypeptide of the invention may include Hla and EsxA and EsxB antigens. These may be in any order, N- to C-terminus. SEQ ID NO: 220 ('HlaH35L-esxAB') is an example of such a triple hybrid, in which a H35L mutant of Hla is joined to EsxAB via linker ASGGGS (SEQ ID NO: 173). The EsxAB already includes the same linker, so SEQ ID NO: 220 includes two of these linkers. Another example of a hybrid polypeptide including Hla and EsxA and EsxB antigens is SEQ ID NO: 237 ('HlaH35L-esxAB' as used in the examples), in which a H35L mutant of Hla is joined to EsxA via linker APTARG (SEQ ID NO: 239) to replace its N-terminus, then to EsxB via linker ASGGGS (SEQ ID NO: 173) to replace its N-terminus. This hybrid can be provided with a suitable N-terminal sequence such as SEQ ID NO: 240.

Another hybrid polypeptide of the invention may include sta006 and EsxA and EsxB antigens. These may be in any order, N- to C-terminus. SEQ ID NO: 223 ('sta006-esxAB') is an example of such a triple hybrid, in which sta006 is joined to EsxAB via linker ASGGGS (SEQ ID NO: 173). The EsxAB already includes the same linker, so SEQ ID NO: 223 includes two of these linkers. Another example of a hybrid polypeptide including sta006 and EsxA and EsxB antigens is SEQ ID NO: 238 ('sta006-esxAB' as used in the examples), in which a sta006 is joined to EsxA via linker APTARG (SEQ ID NO: 239) to replace its N-terminus, then to EsxB via linker ASGGGS (SEQ ID NO: 173) to replace its N-terminus. This hybrid can be provided with a suitable N-terminal sequence such as SEQ ID NO: 240.

Usefully, these hybrid polypeptides can elicit an antibody (e.g. when administered to a human) that recognise each of the wild-type staphylococcal proteins (e.g. as shown in the sequence listing) represented in the hybrid e.g. which recognise both wild-type EsxA and wild-type EsxB, or which recognise both wild-type SdrD and wild-type SdrE, or which recognise both wild-type SdrD and wild-type ClfB, or which recognise both wild-type IsdA and wild-type EsxA, or which recognise both wild-type IsdA and wild-type sta006, or which recognise both wild-type Hla and wild-type sta006, or which recognise both wild-type Hla and wild-type Emp, or which recognise wild-type IsdA and wild-type EsxA and wild-type EsxB, or which recognise wild-type Hla and wild-type EsxA and wild-type EsxB, or which recognise wild-type sta006 and wild-type EsxA and wild-type EsxB.

Polypeptides Used With the Invention

Polypeptides used with the invention can take various forms (e.g. native, fusions, glycosylated, non-glycosylated, lipidated, non-lipidated, phosphorylated, non-phosphorylated, myristoylated, non-myristoylated, monomeric, multimeric, particulate, denatured, etc.).

Polypeptides used with the invention can be prepared by various means (e.g. recombinant expression, purification from cell culture, chemical synthesis, etc.). Recombinantly-expressed proteins are preferred, particularly for hybrid polypeptides.

Polypeptides used with the invention are preferably provided in purified or substantially purified form i.e. substantially free from other polypeptides (e.g. free from naturally-occurring polypeptides), particularly from other staphylococcal or host cell polypeptides, and are generally at least about 50% pure (by weight), and usually at least about 90% pure i.e. less than about 50%, and more preferably less than about 10% (e.g. 5%) of a composition is made up of other expressed polypeptides. Thus the antigens in the compositions are separated from the whole organism with which the molecule is expressed.

Polypeptides used with the invention are preferably staphylococcal polypeptides.

The term "polypeptide" refers to amino acid polymers of any length. The polymer may be linear or branched, it may comprise modified amino acids, and it may be interrupted by non-amino acids. The terms also encompass an amino acid polymer that has been modified naturally or by intervention; for example, disulfide bond formation, glycosylation, lipidation, acetylation, phosphorylation, or any other manipulation or modification, such as conjugation with a labeling component. Also included are, for example, polypeptides containing one or more analogs of an amino acid (including, for example, unnatural amino acids, etc.), as well as other modifications known in the art. Polypeptides can occur as single chains or associated chains.

The invention provides polypeptides comprising a sequence —P-Q- or -Q-P—, wherein: —P— is an amino acid sequence as defined above and -Q- is not a sequence as defined above i.e. the invention provides fusion proteins. Where the N-terminus codon of —P— is not ATG, but this codon is not present at the N-terminus of a polypeptide, it will be translated as the standard amino acid for that codon rather than as a Met. Where this codon is at the N-terminus of a polypeptide, however, it will be translated as Met. Examples of -Q- moieties include, but are not limited to, histidine tags (i.e. His$_n$ where n=3, 4, 5, 6, 7, 8, 9, 10 or more), maltose-binding protein, or glutathione-S-transferase (GST).

The invention also provides a process for producing a polypeptide of the invention, comprising the step of culturing a host cell transformed with nucleic acid of the invention under conditions which induce polypeptide expression.

Although expression of the polypeptides of the invention may take place in a *Staphylococcus*, the invention will usually use a heterologous host for expression (recombinant expression). The heterologous host may be prokaryotic (e.g. a bacterium) or eukaryotic. It may be *E. coli*, but other suitable hosts include *Bacillus subtilis, Vibrio cholerae, Salmonella typhi, Salmonella typhimurium, Neisseria lactamica, Neisseria cinerea, Mycobacteria* (e.g. *M. tuberculosis*), yeasts, etc. Compared to the wild-type *S. aureus* genes encoding polypeptides of the invention, it is helpful to change codons to optimise expression efficiency in such hosts without affecting the encoded amino acids.

The invention provides a process for producing a polypeptide of the invention, comprising the step of synthesising at least part of the polypeptide by chemical means.

Nucleic Acids

The invention also provides nucleic acid encoding polypeptides and hybrid polypeptides of the invention. It also provides nucleic acid comprising a nucleotide sequence that encodes one or more polypeptides or hybrid polypeptides of the invention.

The invention also provides nucleic acid comprising nucleotide sequences having sequence identity to such nucleotide sequences. Identity between sequences is preferably determined by the Smith-Waterman homology search algorithm as described above. Such nucleic acids include those using alternative codons to encode the same amino acid.

The invention also provides nucleic acid which can hybridize to these nucleic acids. Hybridization reactions can be performed under conditions of different "stringency". Conditions that increase stringency of a hybridization reaction of widely known and published in the art (e.g. page 7.52 of reference 276). Examples of relevant conditions include (in order of increasing stringency): incubation temperatures of 25° C., 37° C., 50° C., 55° C. and 68° C.; buffer concentrations of 10×SSC, 6×SSC, 1×SSC, 0.1×SSC (where SSC is 0.15 M NaCl and 15 mM citrate buffer) and their equivalents using other buffer systems; formamide concentrations of 0%, 25%, 50%, and 75%; incubation times from 5 minutes to 24 hours; 1, 2, or more washing steps; wash incubation times of 1, 2, or 15 minutes; and wash solutions of 6×SSC, 1×SSC, 0.1×SSC, or de-ionized water. Hybridization techniques and their optimization are well known in the art (e.g. see refs 75, 76, 276, 278, etc.].

In some embodiments, nucleic acid of the invention hybridizes to a target under low stringency conditions; in other embodiments it hybridizes under intermediate stringency conditions; in preferred embodiments, it hybridizes under high stringency conditions. An exemplary set of low stringency hybridization conditions is 50° C. and 10×SSC. An exemplary set of intermediate stringency hybridization conditions is 55° C. and 1×SSC. An exemplary set of high stringency hybridization conditions is 68° C. and 0.1×SSC.

The invention includes nucleic acid comprising sequences complementary to these sequences (e.g. for antisense or probing, or for use as primers).

Nucleic acids of the invention can be used in hybridisation reactions (e.g. Northern or Southern blots, or in nucleic acid microarrays or 'gene chips') and amplification reactions (e.g. PCR, SDA, SSSR, LCR, TMA, NASBA, etc.) and other nucleic acid techniques.

Nucleic acid according to the invention can take various forms (e.g. single-stranded, double-stranded, vectors, primers, probes, labelled etc.). Nucleic acids of the invention may be circular or branched, but will generally be linear. Unless otherwise specified or required, any embodiment of the invention that utilizes a nucleic acid may utilize both the double-stranded form and each of two complementary single-stranded forms which make up the double-stranded form. Primers and probes are generally single-stranded, as are antisense nucleic acids.

Nucleic acids of the invention are preferably provided in purified or substantially purified form i.e. substantially free from other nucleic acids (e.g. free from naturally-occurring nucleic acids), particularly from other staphylococcal or host cell nucleic acids, generally being at least about 50% pure (by weight), and usually at least about 90% pure. Nucleic acids of the invention are preferably staphylococcal nucleic acids.

Nucleic acids of the invention may be prepared in many ways e.g. by chemical synthesis (e.g. phosphoramidite synthesis of DNA) in whole or in part, by digesting longer nucleic acids using nucleases (e.g. restriction enzymes), by joining shorter nucleic acids or nucleotides (e.g. using ligases or polymerases), from genomic or cDNA libraries, etc.

Nucleic acid of the invention may be attached to a solid support (e.g. a bead, plate, filter, film, slide, microarray support, resin, etc.). Nucleic acid of the invention may be labelled e.g. with a radioactive or fluorescent label, or a biotin label. This is particularly useful where the nucleic acid is to be used in detection techniques e.g. where the nucleic acid is a primer or as a probe.

The term "nucleic acid" includes in general means a polymeric form of nucleotides of any length, which contain deoxyribonucleotides, ribonucleotides, and/or their analogs. It includes DNA, RNA, DNA/RNA hybrids. It also includes DNA or RNA analogs, such as those containing modified backbones (e.g. peptide nucleic acids (PNAs) or phosphorothioates) or modified bases. Thus the invention includes mRNA, tRNA, rRNA, ribozymes, DNA, cDNA, recombinant nucleic acids, branched nucleic acids, plasmids, vectors, probes, primers, etc. Where nucleic acid of the invention takes the form of RNA, it may or may not have a 5' cap.

Nucleic acids of the invention may be part of a vector i.e. part of a nucleic acid construct designed for transduction/transfection of one or more cell types. Vectors may be, for example, "cloning vectors" which are designed for isolation, propagation and replication of inserted nucleotides, "expression vectors" which are designed for expression of a nucleotide sequence in a host cell, "viral vectors" which is designed to result in the production of a recombinant virus or virus-like particle, or "shuttle vectors", which comprise the attributes of more than one type of vector. Preferred vectors are plasmids. A "host cell" includes an individual cell or cell culture which can be or has been a recipient of exogenous nucleic acid. Host cells include progeny of a single host cell, and the progeny may not necessarily be completely identical (in morphology or in total DNA complement) to the original parent cell due to natural, accidental, or deliberate mutation and/or change. Host cells include cells transfected or infected in vivo or in vitro with nucleic acid of the invention.

Where a nucleic acid is DNA, it will be appreciated that "U" in a RNA sequence will be replaced by "T" in the DNA. Similarly, where a nucleic acid is RNA, it will be appreciated that "T" in a DNA sequence will be replaced by "U" in the RNA.

The term "complement" or "complementary" when used in relation to nucleic acids refers to Watson-Crick base pairing. Thus the complement of C is G, the complement of G is C, the complement of A is T (or U), and the complement of T (or U) is A. It is also possible to use bases such as I (the purine inosine) e.g. to complement pyrimidines (C or T).

Nucleic acids of the invention can be used, for example: to produce polypeptides; as hybridization probes for the detection of nucleic acid in biological samples; to generate additional copies of the nucleic acids; to generate ribozymes or antisense oligonucleotides; as single-stranded DNA primers or probes; or as triple-strand forming oligonucleotides.

The invention provides a process for producing nucleic acid of the invention, wherein the nucleic acid is synthesised in part or in whole using chemical means.

The invention provides vectors comprising nucleotide sequences of the invention (e.g. cloning or expression vectors) and host cells transformed with such vectors.

Nucleic acid amplification according to the invention may be quantitative and/or real-time.

For certain embodiments of the invention, nucleic acids are preferably at least 7 nucleotides in length (e.g. 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 45, 50, 55, 60, 65, 70, 75, 80, 90, 100, 110, 120, 130, 140, 150, 160, 170, 180, 190, 200, 225, 250, 275, 300 nucleotides or longer).

For certain embodiments of the invention, nucleic acids are preferably at most 500 nucleotides in length (e.g. 450, 400, 350, 300, 250, 200, 150, 140, 130, 120, 110, 100, 90, 80, 75, 70, 65, 60, 55, 50, 45, 40, 39, 38, 37, 36, 35, 34, 33, 32, 31, 30, 29, 28, 27, 26, 25, 24, 23, 22, 21, 20, 19, 18, 17, 16, 15 nucleotides or shorter).

Primers and probes of the invention, and other nucleic acids used for hybridization, are preferably between 10 and 30 nucleotides in length (e.g. 10, 11, 12, 13, 14, 15, 16, 17, 18, 19, 20, 21, 22, 23, 24, 25, 26, 27, 28, 29, or 30 nucleotides).

Strains and Variants

Antigens are defined above by reference to existing nomenclature (e.g. "ClfA"), to "sta" numbers or to "NW_" numbers. Table 1 herein relates these three naming/numbering systems to existing SAOUHSC numbering and/or NWMN numbering. SAOUHSC numbering refers to the genome of S. aureus strain NCTC 8325 (sequenced by Oklahoma University Health Sciences Center and disclosed in GenBank as CP000253.1; 61:87201381), and individual SAOUHSC numbers are given as "locus_tag" entries in the genome sequence's "features" section. Similarly, NWMN numbering refers to the genome of S. aureus strain Newman (isolated in 1952 from a human infection, and having robust virulence phenotype) disclosed in GenBank as AP009351.1 (GI:150373012) and individual NWMN numbers are given as "locus_tag" entries in the genome sequence's "features" section. Functional annotations for each antigen are also given in the databases.

Table 1 also includes the GI number for each antigen of the invention. Thus an exemplary amino acid and nucleotide sequence for any of these antigens can easily be found in public sequence databases from the NCTC 8325 and/or Newman strain, but the invention is not limited to sequences from the NCTC 8325 and Newman strains. Genome sequences of several other strains of S. aureus are available, including those of MRSA strains N315 and Mu50 [77], MW2, N315, COL, MRSA252, MSSA476, RF122, USA300 (very virulent), JH1 and JH9. Standard search and alignment techniques can be used to identify in any of these (or other) further genome sequences the homolog of any particular sequence from the Newman or NCTC 8325 strain. Moreover, the available sequences from the Newman and NCTC 8325 strains can be used to design primers for amplification of homologous sequences from other strains. Thus the invention is not limited to these two strains, but rather encompasses such variants and homologs from other strains of S. aureus, as well as nonnatural variants. In general, suitable variants of a particular SEQ ID NO include its allelic variants, its polymorphic forms, its homologs, its orthologs, its paralogs, its mutants, etc.

Thus, for instance, polypeptides used with the invention may, compared to the SEQ ID NO herein, include one or more (e.g. 1, 2, 3, 4, 5, 6, 7, 8, 9, etc.) amino acid substitutions, such as conservative substitutions (i.e. substitutions of one amino acid with another which has a related side chain). Genetically-encoded amino acids are generally divided into four families: (1) acidic i.e. aspartate, glutamate; (2) basic i.e. lysine, arginine, histidine; (3) non-polar i.e. alanine, valine, leucine, isoleucine, proline, phenylalanine, methionine, tryptophan; and (4) uncharged polar i.e. glycine, asparagine, glutamine, cysteine, serine, threonine, tyrosine. Phenylalanine, tryptophan, and tyrosine are sometimes classified jointly as aromatic amino acids. In general, substitution of single amino acids within these families does not have a major effect on the biological activity. The polypeptides may also include one or more (e.g. 1, 2, 3, 4, 5, 6, 7, 8, 9, etc.) single amino acid deletions relative to the SEQ ID NO sequences. The polypeptides may also include one or more (e.g. 1, 2, 3, 4, 5, 6, 7, 8, 9, etc.) insertions (e.g. each of 1, 2, 3, 4 or 5 amino acids) relative to the SEQ ID NO sequences.

Similarly, a polypeptide used with the invention may comprise an amino acid sequence that: is identical (i.e. 100% identical) to a sequence disclosed in the sequence listing;

shares sequence identity (e.g. 80%, 85%, 90%, 91%, 92%, 93%, 94%, 95%, 96%, 97%, 98%, 99%, 99.5% or more) with a sequence disclosed in the sequence listing;

has 1, 2, 3, 4, 5, 6, 7, 8, 9 or 10 (or more) single amino acid alterations (deletions, insertions, substitutions), which may be at separate locations or may be contiguous, as compared to the sequences of (a) or (b); and when aligned with a particular sequence from the sequence listing using a pairwise alignment algorithm, each moving window of x amino acids from N-terminus to C-terminus (such that for an alignment that extends to p amino acids, where p>x, there are p−x+1 such windows) has at least x·y identical aligned amino acids, where: x is selected from 20, 25, 30, 35, 40, 45, 50, 60, 70, 80, 90, 100, 150, 200; y is selected from 0.50, 0.60, 0.70, 0.75, 0.80, 0.85, 0.90, 0.91, 0.92, 0.93, 0.94, 0.95, 0.96, 0.97, 0.98, 0.99; and if x·y is not an integer then it is rounded up to the nearest integer. The preferred pairwise alignment algorithm is the Needleman-Wunsch global alignment algorithm [78], using default parameters (e.g. with Gap opening penalty=10.0, and with Gap extension penalty=0.5, using the EBLOSUM62 scoring matrix). This algorithm is conveniently implemented in the needle tool in the EMBOSS package [79].

Where hybrid polypeptides are used, the individual antigens within the hybrid (i.e. individual —X— moieties) may be from one or more strains. Where n=2, for instance, $X_2$ may be from the same strain as $X_1$ or from a different strain. Where n=3, the strains might be (i) $X_1=X_2=X_3$ (ii) $X_1=X_2 \neq X_3$ (iii) $X_1 \neq X_2 = X_3$ (iv) $X_1 \neq X_2 \neq X_3$ or (v) $X_1 = X_3 \neq X_2$, etc.

Within group (c), deletions or substitutions may be at the N-terminus and/or C-terminus, or may be between the two termini. Thus a truncation is an example of a deletion. Truncations may involve deletion of up to 40 (or more) amino acids at the N-terminus and/or C-terminus. N-terminus truncation can remove leader peptides e.g. to facilitate recombinant expression in a heterologous host. C-terminus truncation can remove anchor sequences e.g. to facilitate recombinant expression in a heterologous host.

In general, when an antigen comprises a sequence that is not identical to a complete S. aureus sequence from the sequence listing (e.g. when it comprises a sequence listing with <100% sequence identity thereto, or when it comprises a fragment thereof) it is preferred in each individual instance that the antigen can elicit an antibody which recognises the respective complete S. aureus sequence.

Mutant Bacteria

The invention also provides a S. aureus bacterium in which one or more of the antigens from the various antigen groups of the invention has/have been knocked out. Techniques for producing knockout bacteria are well known, and knockout S.

*aureus* strains have been reported. A knockout mutation may be situated in the coding region of the gene or may lie within its transcriptional control regions (e.g. within its promoter). A knockout mutation will reduce the level of mRNA encoding the antigen to <1% of that produced by the wild-type bacterium, preferably <0.5%, more preferably <0.1%, and most preferably to 0%.

The invention also provides a *S. aureus* in which one or more of the antigens from the various antigen groups of the invention has a mutation which inhibits its activity. The gene encoding the antigen will have a mutation that changes the encoded amino acid sequence. Mutation may involve deletion, substitution, and/or insertion, any of which may involve one or more amino acids. For example, the disclosure provides a *S. aureus* having a mutated Hla antigen containing a deletion of the stem-like structure and/or a mutation of the tyrosine residue corresponding to amino acid 101 of SEQ ID NO: 231, as provided herein.

The invention also provides a bacterium, such as a *S. aureus* bacterium, which hyper-expresses an antigen of the invention.

The invention also provides a bacterium, such as a *S. aureus* bacterium, that constitutively expresses an antigen of the invention. The invention also provides a meningococcus comprising a gene encoding an antigen of the invention, wherein the gene is under the control of an inducible promoter.

Immunogenic Compositions and Medicaments

Immunogenic compositions of the invention may be useful as vaccines. Vaccines according to the invention may either be prophylactic (i.e. to prevent infection) or therapeutic (i.e. to treat infection), but will typically be prophylactic.

Compositions may thus be pharmaceutically acceptable. They will usually include components in addition to the antigens e.g. they typically include one or more pharmaceutical carrier(s) and/or excipient(s). A thorough discussion of such components is available in reference 273.

Compositions will generally be administered to a mammal in aqueous form. Prior to administration, however, the composition may have been in a non-aqueous form. For instance, although some vaccines are manufactured in aqueous form, then filled and distributed and administered also in aqueous form, other vaccines are lyophilised during manufacture and are reconstituted into an aqueous form at the time of use. Thus a composition of the invention may be dried, such as a lyophilised formulation.

The composition may include preservatives such as thiomersal or 2-phenoxyethanol. It is preferred, however, that the vaccine should be substantially free from (i.e. less than 5 μg/ml) mercurial material e.g. thiomersal-free. Vaccines containing no mercury are more preferred. Preservative-free vaccines are particularly preferred.

To improve thermal stability, a composition may include a temperature protective agent. Further details of such agents are provided below.

To control tonicity, it is preferred to include a physiological salt, such as a sodium salt. Sodium chloride (NaCl) is preferred, which may be present at between 1 and 20 mg/ml e.g. about 10±2 mg/ml NaCl. Other salts that may be present include potassium chloride, potassium dihydrogen phosphate, disodium phosphate dehydrate, magnesium chloride, calcium chloride, etc.

Compositions will generally have an osmolality of between 200 mOsm/kg and 400 mOsm/kg, preferably between 240-360 mOsm/kg, and will more preferably fall within the range of 290-310 mOsm/kg.

Compositions may include one or more buffers. Typical buffers include: a phosphate buffer; a Tris buffer; a borate buffer; a succinate buffer; a histidine buffer (particularly with an aluminum hydroxide adjuvant); or a citrate buffer. Buffers will typically be included in the 5-20 mM range.

The pH of a composition will generally be between 5.0 and 8.1, and more typically between 6.0 and 8.0 e.g. 6.5 and 7.5, or between 7.0 and 7.8.

The composition is preferably sterile. The composition is preferably non-pyrogenic e.g. containing <1 EU (endotoxin unit, a standard measure) per dose, and preferably <0.1 EU per dose. The composition is preferably gluten free.

The composition may include material for a single immunisation, or may include material for multiple immunisations (i.e. a 'multidose' kit). The inclusion of a preservative is preferred in multidose arrangements. As an alternative (or in addition) to including a preservative in multidose compositions, the compositions may be contained in a container having an aseptic adaptor for removal of material.

Human vaccines are typically administered in a dosage volume of about 0.5 ml, although a half dose (i.e. about 0.25 ml) may be administered to children.

Immunogenic compositions of the invention may also comprise one or more immunoregulatory agents. Preferably, one or more of the immunoregulatory agents include one or more adjuvants. The adjuvants may include a TH1 adjuvant and/or a TH2 adjuvant, further discussed below.

Thus the invention provides an immunogenic composition comprising a combination of:
(1) one or more antigen(s) selected from the first, second, third and fourth antigen groups (as defined above); and
(2) an adjuvant, such as an aluminium hydroxide adjuvant (for example, one or more antigens may be adsorbed to aluminium hydroxide).

Thus the invention further provides an immunogenic composition comprising a combination of:
(1) a loop-deleted Hla polypeptide and optionally one or more antigen(s) selected from the first, second, third and fourth antigen groups (as defined above); and
(2) an adjuvant, such as an aluminium hydroxide adjuvant (for example, one or more antigens may be adsorbed to aluminium hydroxide).

Thus the invention further provides an immunogenic composition comprising a combination of:
(1) a Hla polypeptide having a mutation of the tyrosine residue corresponding to amino acid 101 of SEQ ID NO: 231 and optionally one or more antigen(s) selected from the first, second, third and fourth antigen groups (as defined above); and
(2) an adjuvant, such as an aluminium hydroxide adjuvant (for example, one or more antigens may be adsorbed to aluminium hydroxide).

For instance, the invention provides an immunogenic composition comprising a combination of a sta006 antigen and an adjuvant, such as an aluminium hydroxide adjuvant. Similarly, the invention provides an immunogenic composition comprising a combination of a sta011 antigen and an adjuvant, such as an aluminium hydroxide adjuvant. These compositions are ideally buffered e.g. with a histidine buffer.

Adjuvants which may be used in compositions of the invention include, but are not limited to:

A. Mineral-Containing Compositions

Mineral containing compositions suitable for use as adjuvants in the invention include mineral salts, such as aluminium salts and calcium salts (or mixtures thereof). Calcium salts include calcium phosphate (e.g. the "CAP" particles disclosed in ref. 80). Aluminum salts include hydroxides, phosphates, sulfates, etc., with the salts taking any suitable form (e.g. gel, crystalline, amorphous, etc.). Adsorption to these salts is preferred (e.g. all antigens may be adsorbed). The mineral containing compositions may also be formulated as a particle of metal salt [81].

The adjuvants known as aluminum hydroxide and aluminum phosphate may be used. These names are conventional, but are used for convenience only, as neither is a precise description of the actual chemical compound which is present (e.g. see chapter 9 of reference 82)). The invention can use any of the "hydroxide" or "phosphate" adjuvants that are in general use as adjuvants. The adjuvants known as "aluminium hydroxide" are typically aluminium oxyhydroxide salts, which are usually at least partially crystalline. The adjuvants known as "aluminium phosphate" are typically aluminium hydroxyphosphates, often also containing a small amount of sulfate (i.e. aluminium hydroxyphosphate sulfate). They may be obtained by precipitation, and the reaction conditions and concentrations during precipitation influence the degree of substitution of phosphate for hydroxyl in the salt.

A fibrous morphology (e.g. as seen in transmission electron micrographs) is typical for aluminium hydroxide adjuvants. The pI of aluminium hydroxide adjuvants is typically about 11 i.e. the adjuvant itself has a positive surface charge at physiological pH. Adsorptive capacities of between 1.8-2.6 mg protein per mg $Al^{+++}$ at pH 7.4 have been reported for aluminium hydroxide adjuvants.

Aluminium phosphate adjuvants generally have a $PO_4/Al$ molar ratio between 0.3 and 1.2, preferably between 0.8 and 1.2, and more preferably 0.95±0.1. The aluminium phosphate will generally be amorphous, particularly for hydroxyphosphate salts. A typical adjuvant is amorphous aluminium hydroxyphosphate with $PO_4/Al$ molar ratio between 0.84 and 0.92, included at 0.6 mg $Al^{3+}$/ml. The aluminium phosphate will generally be particulate (e.g. plate-like morphology as seen in transmission electron micrographs). Typical diameters of the particles are in the range 0.5-20 µm (e.g. about 5-10 µm) after any antigen adsorption. Adsorptive capacities of between 0.7-1.5 mg protein per mg $Al^{+++}$ at pH 7.4 have been reported for aluminium phosphate adjuvants.

The point of zero charge (PZC) of aluminium phosphate is inversely related to the degree of substitution of phosphate for hydroxyl, and this degree of substitution can vary depending on reaction conditions and concentration of reactants used for preparing the salt by precipitation. PZC is also altered by changing the concentration of free phosphate ions in solution (more phosphate=more acidic PZC) or by adding a buffer such as a histidine buffer (makes PZC more basic). Aluminium phosphates used according to the invention will generally have a PZC of between 4.0 and 7.0, more preferably between 5.0 and 6.5 e.g. about 5.7.

As shown below, adsorption of S. aureus protein antigens (except IsdA, Sta019 and Sta073) to an aluminium hydroxide adjuvant is advantageous, particularly in a multi-protein combination (in which all antigens may be adsorbed). A histidine buffer can usefully be included in such adjuvanted compositions.

Suspensions of aluminium salts used to prepare compositions of the invention may contain a buffer (e.g. a phosphate or a histidine or a Tris buffer), but this is not always necessary. The suspensions are preferably sterile and pyrogen-free. A suspension may include free aqueous phosphate ions e.g. present at a concentration between 1.0 and 20 mM, preferably between 5 and 15 mM, and more preferably about 10 mM. The suspensions may also comprise sodium chloride.

The invention can use a mixture of both an aluminium hydroxide and an aluminium phosphate. In this case there may be more aluminium phosphate than hydroxide e.g. a weight ratio of at least 2:1 e.g. ≥5:1, ≥6:1, ≥7:1, ≥8:1, ≥9:1, etc.

The concentration of $Al^{+++}$ in a composition for administration to a patient is preferably less than 10 mg/ml e.g. ≤5 mg/ml, ≤4 mg/ml, ≤3 mg/ml, ≤2 mg/ml, ≤1 mg/ml, etc. A preferred range is between 0.3 and 1 mg/ml. A maximum of 0.85 mg/dose is preferred.

B. Oil Emulsions

Oil emulsion compositions suitable for use as adjuvants in the invention include squalene-water emulsions, such as MF59 [Chapter 10 of ref. 82; see also ref. 83] (5% Squalene, 0.5% Tween 80, and 0.5% Span 85, formulated into submicron particles using a microfluidizer). Complete Freund's adjuvant (CFA) and incomplete Freund's adjuvant (IFA) may also be used.

Various oil-in-water emulsion adjuvants are known, and they typically include at least one oil and at least one surfactant, with the oil(s) and surfactant(s) being biodegradable (metabolisable) and biocompatible. The oil droplets in the emulsion are generally less than 5 µm in diameter, and ideally have a sub-micron diameter, with these small sizes being achieved with a microfluidiser to provide stable emulsions. Droplets with a size less than 220 nm are preferred as they can be subjected to filter sterilization.

The emulsion can comprise oils such as those from an animal (such as fish) or vegetable source. Sources for vegetable oils include nuts, seeds and grains. Peanut oil, soybean oil, coconut oil, and olive oil, the most commonly available, exemplify the nut oils. Jojoba oil can be used e.g. obtained from the jojoba bean. Seed oils include safflower oil, cottonseed oil, sunflower seed oil, sesame seed oil and the like. In the grain group, corn oil is the most readily available, but the oil of other cereal grains such as wheat, oats, rye, rice, teff, triticale and the like may also be used. 6-10 carbon fatty acid esters of glycerol and 1,2-propanediol, while not occurring naturally in seed oils, may be prepared by hydrolysis, separation and esterification of the appropriate materials starting from the nut and seed oils. Fats and oils from mammalian milk are metabolizable and may therefore be used in the practice of this invention. The procedures for separation, purification, saponification and other means necessary for obtaining pure oils from animal sources are well known in the art. Most fish contain metabolizable oils which may be readily recovered. For example, cod liver oil, shark liver oils, and whale oil such as spermaceti exemplify several of the fish oils which may be used herein. A number of branched chain oils are synthesized biochemically in 5-carbon isoprene units and are generally referred to as terpenoids. Shark liver oil contains a branched, unsaturated terpenoids known as squalene, 2,6,10,15,19,23-hexamethyl-2,6,10,14,18,22-tetracosahexaene, which is particularly preferred herein. Squalane, the saturated analog to squalene, is also a preferred oil. Fish oils, including squalene and squalane, are readily available from commercial sources or may be obtained by methods known in the art. Other preferred oils are the tocopherols (see below). Mixtures of oils can be used.

Surfactants can be classified by their 'HLB' (hydrophile/lipophile balance). Preferred surfactants of the invention have a HLB of at least 10, preferably at least 15, and more preferably at least 16. The invention can be used with surfactants including, but not limited to: the polyoxyethylene sorbitan esters surfactants (commonly referred to as the Tweens), especially polysorbate 20 and polysorbate 80; copolymers of ethylene oxide (EU), propylene oxide (PO), and/or butylene oxide (BO), sold under the DOWFAX™ tradename, such as linear EO/PO block copolymers; octoxynols, which can vary in the number of repeating ethoxy (oxy-1,2-ethanediyl) groups, with octoxynol-9 (Triton X-100, or t-octylphenoxypolyethoxyethanol) being of particular interest; (octylphenoxy)polyethoxyethanol (IGEPAL CA-630/NP-40); phospholipids such as phosphatidylcholine (lecithin); nonylphenol ethoxylates, such as the Tergitol™ NP series; polyoxyethylene fatty ethers derived from lauryl, cetyl, stearyl and oleyl alcohols (known as Brij surfactants), such as triethyleneglycol monolauryl ether (Brij 30); and sorbitan esters (commonly known as the SPANs), such as sorbitan trioleate (Span 85) and sorbitan monolaurate. Non-ionic surfactants are preferred. Preferred surfactants for including in the emulsion are Tween 80 (polyoxyethylene sorbitan monooleate), Span 85 (sorbitan trioleate), lecithin and Triton X-100.

Mixtures of surfactants can be used e.g. Tween 80/Span 85 mixtures. A combination of a polyoxyethylene sorbitan ester such as polyoxyethylene sorbitan monooleate (Tween 80) and an octoxynol such as t-octylphenoxypolyethoxyethanol (Triton X-100) is also suitable. Another useful combination comprises laureth 9 plus a polyoxyethylene sorbitan ester and/or an octoxynol.

Preferred amounts of surfactants (% by weight) are: polyoxyethylene sorbitan esters (such as Tween 80) 0.01 to 1%, in particular about 0.1%; octyl- or nonylphenoxy polyoxyethanols (such as Triton X-100, or other detergents in the Triton series) 0.001 to 0.1%, in particular 0.005 to 0.02%; polyoxyethylene ethers (such as laureth 9) 0.1 to 20%, preferably 0.1 to 10% and in particular 0.1 to 1% or about 0.5%.

Preferred emulsion adjuvants have an average droplets size of <1 μm e.g. ≤750 nm, ≤500 nm, ≤400 nm, ≤300 nm, ≤250 nm, ≤220 nm, ≤200 nm, or smaller. These droplet sizes can conveniently be achieved by techniques such as microfluidisation.

Specific oil-in-water emulsion adjuvants useful with the invention include, but are not limited to:

A submicron emulsion of squalene, Tween 80, and Span 85. The composition of the emulsion by volume can be about 5% squalene, about 0.5% polysorbate 80 and about 0.5% Span 85. In weight terms, these ratios become 4.3% squalene, 0.5% polysorbate 80 and 0.48% Span 85. This adjuvant is known as 'MF59' [84-86], as described in more detail in Chapter 10 of ref. 87 and chapter 12 of ref. 88. The MF59 emulsion advantageously includes citrate ions e.g. 10 mM sodium citrate buffer.

An emulsion of squalene, a tocopherol, and polysorbate 80 (Tween 80). The emulsion may include phosphate buffered saline. It may also include Span 85 (e.g. at 1%) and/or lecithin. These emulsions may have from 2 to 10% squalene, from 2 to 10% tocopherol and from 0.3 to 3% Tween 80, and the weight ratio of squalene:tocopherol is preferably ≤1 as this provides a more stable emulsion. Squalene and Tween 80 may be present volume ratio of about 5:2 or at a weight ratio of about 11:5. One such emulsion can be made by dissolving Tween 80 in PBS to give a 2% solution, then mixing 90 ml of this solution with a mixture of (5 g of DL-α-tocopherol and 5 ml squalene), then microfluidising the mixture. The resulting emulsion may have submicron oil droplets e.g. with an average diameter of between 100 and 250 nm, preferably about 180 nm. The emulsion may also include a 3-de-O-acylated monophosphoryl lipid A (3d-MPL). Another useful emulsion of this type may comprise, per human dose, 0.5-10 mg squalene, 0.5-11 mg tocopherol, and 0.1-4 mg polysorbate 80 [89].

An emulsion of squalene, a tocopherol, and a Triton detergent (e.g. Triton X-100). The emulsion may also include a 3d-MPL (see below). The emulsion may contain a phosphate buffer.

An emulsion comprising a polysorbate (e.g. polysorbate 80), a Triton detergent (e.g. Triton X-100) and a tocopherol (e.g. an α-tocopherol succinate). The emulsion may include these three components at a mass ratio of about 75:11:10 (e.g. 750 μg/ml polysorbate 80, 110 μg/ml Triton X-100 and 100 μg/ml α-tocopherol succinate), and these concentrations should include any contribution of these components from antigens. The emulsion may also include squalene. The emulsion may also include a 3d-MPL (see below). The aqueous phase may contain a phosphate buffer.

An emulsion of squalane, polysorbate 80 and poloxamer 401 ("Pluronic™ L121"). The emulsion can be formulated in phosphate buffered saline, pH 7.4. This emulsion is a useful delivery vehicle for muramyl dipeptides, and has been used with threonyl-MDP in the "SAF-1" adjuvant [90] (0.05-1% Thr-MDP, 5% squalane, 2.5% Pluronic L121 and 0.2% polysorbate 80). It can also be used without the Thr-MDP, as in the "AF" adjuvant [91] (5% squalane, 1.25% Pluronic L121 and 0.2% polysorbate 80). Microfluidisation is preferred.

An emulsion comprising squalene, an aqueous solvent, a polyoxyethylene alkyl ether hydrophilic nonionic surfactant (e.g. polyoxyethylene (12) cetostearyl ether) and a hydrophobic nonionic surfactant (e.g. a sorbitan ester or mannide ester, such as sorbitan monoleate or 'Span 80'). The emulsion is preferably thermoreversible and/or has at least 90% of the oil droplets (by volume) with a size less than 200 nm [92]. The emulsion may also include one or more of: alditol; a cryoprotective agent (e.g. a sugar, such as dodecylmaltoside and/or sucrose); and/or an alkylpolyglycoside. The emulsion may include a TLR4 agonist [93]. Such emulsions may be lyophilized.

An emulsion of squalene, poloxamer 105 and Abil-Care [94]. The final concentration (weight) of these components in adjuvanted vaccines are 5% squalene, 4% poloxamer 105 (pluronic polyol) and 2% Abil-Care 85 (Bis-PEG/PPG-16/16 PEG/PPG-16/16 dimethicone; caprylic/capric triglyceride).

An emulsion having from 0.5-50% of an oil, 0.1-10% of a phospholipid, and 0.05-5% of a non-ionic surfactant. As described in reference 95, preferred phospholipid components are phosphatidylcholine, phosphatidylethanolamine, phosphatidylserine, phosphatidylinositol, phosphatidylglycerol, phosphatidic acid, sphingomyelin and cardiolipin. Submicron droplet sizes are advantageous.

A submicron oil-in-water emulsion of a non-metabolisable oil (such as light mineral oil) and at least one surfactant (such as lecithin, Tween 80 or Span 80). Additives may be included, such as QuilA saponin, cholesterol, a saponin-lipophile conjugate (such as GPI-0100, described in reference 96, produced by addition of aliphatic amine to desacylsaponin via the carboxyl group of glucuronic acid), dimethyidioctadecylammonium bromide and/or N,N-dioctadecyl-N,N-bis(2-hydroxyethyl)propanediamine.

An emulsion in which a saponin (e.g. QuilA or QS21) and a sterol (e.g. a cholesterol) are associated as helical micelles [97].

An emulsion comprising a mineral oil, a non-ionic lipophilic ethoxylated fatty alcohol, and a non-ionic hydrophilic surfactant (e.g. an ethoxylated fatty alcohol and/or polyoxyethylene-polyoxypropylene block copolymer) [98].

An emulsion comprising a mineral oil, a non-ionic hydrophilic ethoxylated fatty alcohol, and a non-ionic lipophilic surfactant (e.g. an ethoxylated fatty alcohol and/or polyoxyethylene-polyoxypropylene block copolymer) [98].

In some embodiments an emulsion may be mixed with antigen extemporaneously, at the time of delivery, and thus the adjuvant and antigen may be kept separately in a packaged or distributed vaccine, ready for final formulation at the time of use. In other embodiments an emulsion is mixed with antigen during manufacture, and thus the composition is packaged in a liquid adjuvanted form. The antigen will generally be in an aqueous form, such that the vaccine is finally prepared by mixing two liquids. The volume ratio of the two liquids for mixing can vary (e.g. between 5:1 and 1:5) but is generally about 1:1. Where concentrations of components are given in the above descriptions of specific emulsions, these concentrations are typically for an undiluted composition, and the concentration after mixing with an antigen solution will thus decrease.

Where a composition includes a tocopherol, any of the α, β, γ, δ, ε or ξ tocopherols can be used, but α-tocopherols are preferred. The tocopherol can take several forms e.g. different salts and/or isomers. Salts include organic salts, such as succinate, acetate, nicotinate, etc. D-α-tocopherol and DL-α-tocopherol can both be used. Tocopherols are advantageously included in vaccines for use in elderly patients (e.g. aged 60 years or older) because vitamin E has been reported to have a positive effect on the immune response in this patient group [99]. They also have antioxidant properties that may help to stabilize the emulsions [100]. A preferred α-tocopherol is DL-α-tocopherol, and the preferred salt of this tocopherol is the succinate. The succinate salt has been found to cooperate with TNF-related ligands in vivo.

C. Saponin Formulations [Chapter 22 of Ref 82]

Saponin formulations may also be used as adjuvants in the invention. Saponins are a heterogeneous group of sterol glycosides and triterpenoid glycosides that are found in the bark, leaves, stems, roots and even flowers of a wide range of plant species. Saponin from the bark of the *Quillaia saponaria* Molina tree have been widely studied as adjuvants. Saponin can also be commercially obtained from *Smilax ornata* (sarsaprilla), *Gypsophilla paniculata* (brides veil), and *Saponaria officianalis* (soap root). Saponin adjuvant formulations include purified formulations, such as QS21, as well as lipid formulations, such as ISCOMs. QS21 is marketed as Stimulon™.

Saponin compositions have been purified using HPLC and RP-HPLC. Specific purified fractions using these techniques have been identified, including QS7, QS17, QS18, QS21, QH-A, QH-B and QH-C. Preferably, the saponin is QS21. A method of production of QS21 is disclosed in ref. 101. Saponin formulations may also comprise a sterol, such as cholesterol [102].

Combinations of saponins and cholesterols can be used to form unique particles called immunostimulating complexes (ISCOMs) [chapter 23 of ref. 82]. ISCOMs typically also include a phospholipid such as phosphatidylethanolamine or phosphatidylcholine. Any known saponin can be used in ISCOMs. Preferably, the ISCOM includes one or more of QuilA, QHA & QHC. ISCOMs are further described in refs. 102-104. Optionally, the ISCOMS may be devoid of additional detergent [105].

A review of the development of saponin based adjuvants can be found in refs. 106 & 107.

D. Virosomes and Virus-Like Particles

Virosomes and virus-like particles (VLPs) can also be used as adjuvants in the invention. These structures generally contain one or more proteins from a virus optionally combined or formulated with a phospholipid. They are generally non-pathogenic, non-replicating and generally do not contain any of the native viral genome. The viral proteins may be recombinantly produced or isolated from whole viruses. These viral proteins suitable for use in virosomes or VLPs include proteins derived from influenza virus (such as HA or NA), Hepatitis B virus (such as core or capsid proteins), Hepatitis E virus, measles virus, Sindbis virus, Rotavirus, Foot-and-Mouth Disease virus, Retrovirus, Norwalk virus, human Papilloma virus, HIV, RNA-phages, Qβ-phage (such as coat proteins), GA-phage, fr-phage, AP205 phage, and Ty (such as retrotransposon Ty protein p1). VLPs are discussed further in refs. 108-113. Virosomes are discussed further in, for example, ref. 114

E. Bacterial or Microbial Derivatives

Adjuvants suitable for use in the invention include bacterial or microbial derivatives such as non-toxic derivatives of enterobacterial lipopolysaccharide (LPS), Lipid A derivatives, immunostimulatory oligonucleotides and ADP-ribosylating toxins and detoxified derivatives thereof.

Non-toxic derivatives of LPS include monophosphoryl lipid A (MPL) and 3-O-deacylated MPL (3dMPL). 3dMPL is a mixture of 3 de-O-acylated monophosphoryl lipid A with 4, 5 or 6 acylated chains. A preferred "small particle" form of 3 De-O-acylated monophosphoryl lipid A is disclosed in ref. 115. Such "small particles" of 3dMPL are small enough to be sterile filtered through a 0.22 μm membrane [115]. Other non-toxic LPS derivatives include monophosphoryl lipid A mimics, such as aminoalkyl glucosaminide phosphate derivatives e.g. RC-529 [116,117].

Lipid A derivatives include derivatives of lipid A from *Escherichia coli* such as OM-174. OM-174 is described for example in refs. 118 & 119.

Immunostimulatory oligonucleotides suitable for use as adjuvants in the invention include nucleotide sequences containing a CpG motif (a dinucleotide sequence containing an unmethylated cytosine linked by a phosphate bond to a guanosine). Double-stranded RNAs and oligonucleotides containing palindromic or poly(dG) sequences have also been shown to be immunostimulatory.

The CpG's can include nucleotide modifications/analogs such as phosphorothioate modifications and can be double-stranded or single-stranded. References 120, 121 and 122 disclose possible analog substitutions e.g. replacement of guanosine with 2'-deoxy-7-deazaguanosine. The adjuvant effect of CpG oligonucleotides is further discussed in refs. 123-128.

The CpG sequence may be directed to TLR9, such as the motif GTCGTT or TTCGTT [129]. The CpG sequence may be specific for inducing a Th1 immune response, such as a CpG-A ODN, or it may be more specific for inducing a B cell response, such a CpG-B ODN. CpG-A and CpG-B ODNs are discussed in refs. 130-132. Preferably, the CpG is a CpG-A ODN.

Preferably, the CpG oligonucleotide is constructed so that the 5' end is accessible for receptor recognition. Optionally, two CpG oligonucleotide sequences may be attached at their 3' ends to form "immunomers". See, for example, refs. 129 & 133-135.

A useful CpG adjuvant is CpG7909, also known as ProMune™ (Coley Pharmaceutical Group, Inc.). Another is CpG1826. As an alternative, or in addition, to using CpG sequences, TpG sequences can be used [136], and these oligonucleotides may be free from unmethylated CpG motifs. The immunostimulatory oligonucleotide may be pyrimidine-rich. For example, it may comprise more than one consecutive thymidine nucleotide (e.g. TTTT, as disclosed in ref. 136), and/or it may have a nucleotide composition with >25% thymidine (e.g. >35%, >40%, >50%, >60%, >80%, etc.). For example, it may comprise more than one consecutive cytosine nucleotide (e.g. CCCC, as disclosed in ref. 136), and/or it may have a nucleotide composition with >25% cytosine (e.g.

>35%, >40%, >50%, >60%, >80%, etc.). These oligonucleotides may be free from unmethylated CpG motifs. Immunostimulatory oligonucleotides will typically comprise at least 20 nucleotides. They may comprise fewer than 100 nucleotides.

A particularly useful adjuvant based around immunostimulatory oligonucleotides is known as IC-31™ [137]. Thus an adjuvant used with the invention may comprise a mixture of (i) an oligonucleotide (e.g. between 15-40 nucleotides) including at least one (and preferably multiple) CpI motifs (i.e. a cytosine linked to an inosine to form a dinucleotide), and (ii) a polycationic polymer, such as an oligopeptide (e.g. between 5-20 amino acids) including at least one (and preferably multiple) Lys-Arg-Lys tripeptide sequence(s). The oligonucleotide may be a deoxynucleotide comprising 26-mer sequence 5'-(IC)$_{13}$-3' (SEQ ID NO: 175). The polycationic polymer may be a peptide comprising 11-mer amino acid sequence KLKLLLLLKLK (SEQ ID NO: 176). The oligonucleotide and polymer can form complexes e.g. as disclosed in references 138 & 139.

Bacterial ADP-ribosylating toxins and detoxified derivatives thereof may be used as adjuvants in the invention. Preferably, the protein is derived from *E. coli* (*E. coli* heat labile enterotoxin "LT"), cholera ("CT"), or pertussis ("PT"). The use of detoxified ADP-ribosylating toxins as mucosal adjuvants is described in ref. 140 and as parenteral adjuvants in ref. 141. The toxin or toxoid is preferably in the form of a holotoxin, comprising both A and B subunits. Preferably, the A subunit contains a detoxifying mutation; preferably the B subunit is not mutated. Preferably, the adjuvant is a detoxified LT mutant such as LT-K63, LT-R72, and LT-G192. The use of ADP-ribosylating toxins and detoxified derivatives thereof, particularly LT-K63 and LT-R72, as adjuvants can be found in refs. 142-149. A useful CT mutant is or CT-E29H [150]. Numerical reference for amino acid substitutions is preferably based on the alignments of the A and B subunits of ADP-ribosylating toxins set forth in ref. 151, specifically incorporated herein by reference in its entirety.

F. Human Immunomodulators

Human immunomodulators suitable for use as adjuvants in the invention include cytokines, such as interleukins (e.g. IL-1, IL-2, IL-4, IL-5, IL-6, IL-7, IL-12 [152], etc.) [153], interferons (e.g. interferon-γ), macrophage colony stimulating factor, and tumor necrosis factor. A preferred immunomodulator is IL-12.

G. Bioadhesives and Mucoadhesives

Bioadhesives and mucoadhesives may also be used as adjuvants in the invention. Suitable bioadhesives include esterified hyaluronic acid microspheres [154] or mucoadhesives such as cross-linked derivatives of poly(acrylic acid), polyvinyl alcohol, polyvinyl pyrollidone, polysaccharides and carboxymethylcellulose. Chitosan and derivatives thereof may also be used as adjuvants in the invention [155].

H. Microparticles

Microparticles may also be used as adjuvants in the invention. Microparticles (i.e. a particle of ~100 nm to ~150 μm in diameter, more preferably ~200 nm to ~30 μm in diameter, and most preferably ~500 nm to ~10 μm in diameter) formed from materials that are biodegradable and non-toxic (e.g. a poly(α-hydroxy acid), a polyhydroxybutyric acid, a polyorthoester, a polyanhydride, a polycaprolactone, etc.), with poly(lactide-co-glycolide) are preferred, optionally treated to have a negatively-charged surface (e.g. with SDS) or a positively-charged surface (e.g. with a cationic detergent, such as CTAB).

I. Liposomes (Chapters 13 & 14 of Ref. 82)

Examples of liposome formulations suitable for use as adjuvants are described in refs. 156-158.

J. Polyoxyethylene Ether and Polyoxyethylene Ester Formulations

Adjuvants suitable for use in the invention include polyoxyethylene ethers and polyoxyethylene esters [159]. Such formulations further include polyoxyethylene sorbitan ester surfactants in combination with an octoxynol [160] as well as polyoxyethylene alkyl ethers or ester surfactants in combination with at least one additional non-ionic surfactant such as an octoxynol [161]. Preferred polyoxyethylene ethers are selected from the following group: polyoxyethylene-9-lauryl ether (laureth 9), polyoxyethylene-9-steoryl ether, polyoxytheylene-8-steoryl ether, polyoxyethylene-4-lauryl ether, polyoxyethylene-35-lauryl ether, and polyoxyethylene-23-lauryl ether.

K. Phosphazenes

A phosphazene, such as poly[di(carboxylatophenoxy)phosphazene] ("PCPP") as described, for example, in references 162 and 163, may be used.

L. Muramyl Peptides

Examples of muramyl peptides suitable for use as adjuvants in the invention include N-acetyl-muramyl-L-threonyl-D-isoglutamine (thr-MDP), N-acetyl-normuramyl-L-alanyl-D-isoglutamine (nor-MDP), and N-acetylmuramyl-L-alanyl-D-isoglutaminyl-L-alanine-2-(1'-2'-dipalmitoyl-sn-glycero-3-hydroxyphosphoryloxy)-ethylamine MTP-PE).

M. Imidazoquinolone Compounds.

Examples of imidazoquinolone compounds suitable for use adjuvants in the invention include Imiquimod ("R-837") [164,165], Resiquimod ("R-848") [166], and their analogs; and salts thereof (e.g. the hydrochloride salts). Further details about immunostimulatory imidazoquinolines can be found in references 167 to 171.

N. Substituted Ureas

Substituted ureas useful as adjuvants include compounds of formula I, II or III, or salts thereof:

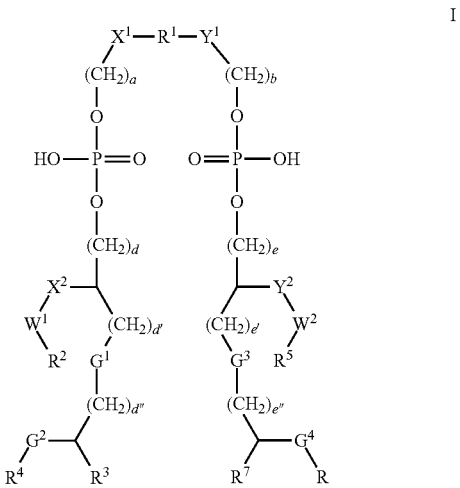

I

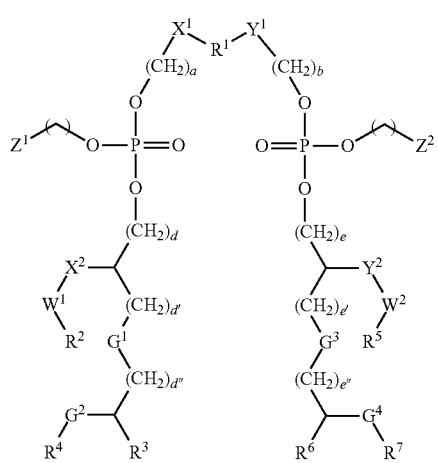
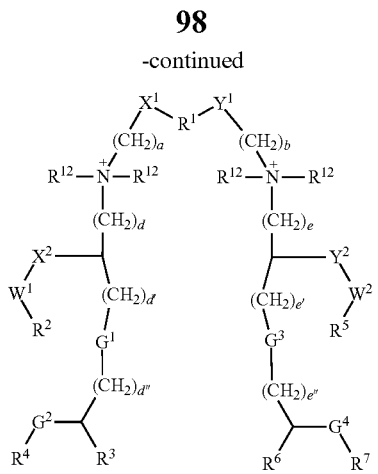
as defined in reference 172, such as 'ER 803058', 'ER 803732', 'ER 804053', ER 804058', 'ER 804059', 'ER 804442', 'ER 804680', 'ER 804764', ER 803022 or 'ER 804057' e.g.:
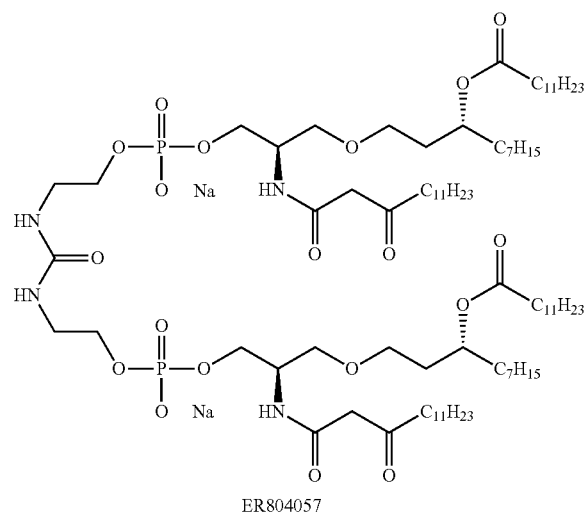
ER804057
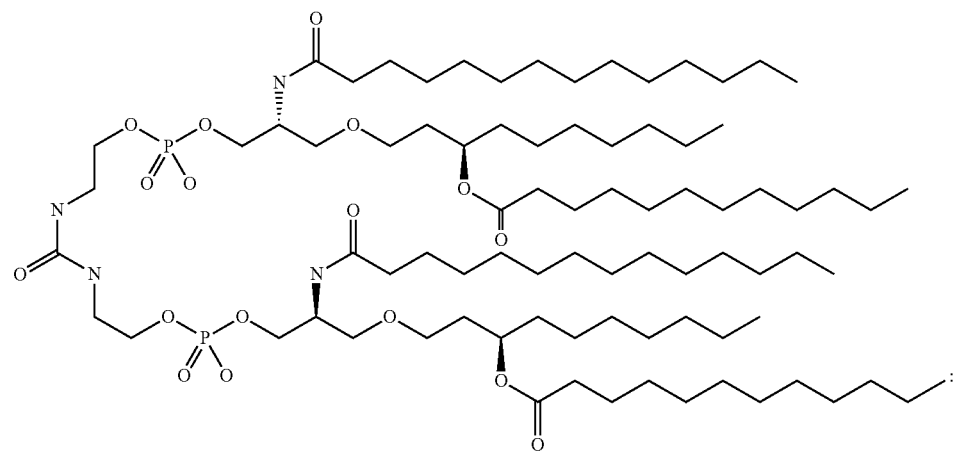
ER-803022

O. Further Adjuvants

Further adjuvants that may be used with the invention include:

An aminoalkyl glucosaminide phosphate derivative, such as RC-529 [173,174].

Cyclic diguanylate ('c-di-GMP'), which has been reported as a useful adjuvant for *S. aureus* vaccines [175].

A thiosemicarbazone compound, such as those disclosed in reference 176. Methods of formulating, manufacturing, and screening for active compounds are also described in reference 176. The thiosemicarbazones are particularly effective in the stimulation of human peripheral blood mononuclear cells for the production of cytokines, such as TNF-α.

A tryptanthrin compound, such as those disclosed in reference 177. Methods of formulating, manufacturing, and screening for active compounds are also described in reference 177. The thiosemicarbazones are particularly effective in the stimulation of human peripheral blood mononuclear cells for the production of cytokines, such as TNF-α.

A nucleoside analog, such as: (a) Isatorabine (ANA-245; 7-thia-8-oxoguanosine):

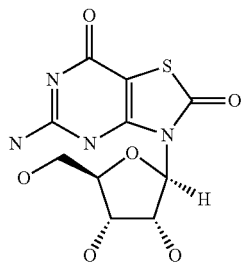 [SMILES: Nc1nc(=O)c2sc(=O)n([C@@H]3O[C@H](CO)[C@@H](O)[C@H]3O)c2[nH]1]

and prodrugs thereof; (b) ANA975; (c) ANA-025-1; (d) ANA380; (e) the compounds disclosed in references 178 to 180Loxoribine (7-allyl-8-oxoguanosine) [181].

Compounds disclosed in reference 182, including:
Acylpiperazine compounds, Indoledione compounds, Tetrahydraisoquinoline (THIQ) compounds, Benzocyclodione compounds, Aminoazavinyl compounds, Aminobenzimidazole quinolinone (ABIQ) compounds [183,184], Hydrapthalamide compounds, Benzophenone compounds, Isoxazole compounds, Sterol compounds, Quinazilinone compounds, Pyrrole compounds [185], Anthraquinone compounds, Quinoxaline compounds, Triazine compounds, Pyrazalopyrimidine compounds, and Benzazole compounds [186].

Compounds containing lipids linked to a phosphate-containing acyclic backbone, such as the TLR4 antagonist E5564 [187,188]:

A polyoxidonium polymer [189,190] or other N-oxidized polyethylene-piperazine derivative.

Methyl inosine 5'-monophosphate ("MIMP") [191].

A polyhydroxlated pyrrolizidine compound [192], such as one having formula:

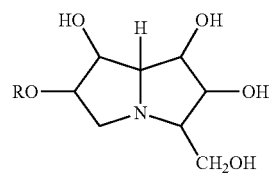

where R is selected from the group comprising hydrogen, straight or branched, unsubstituted or substituted, saturated or unsaturated acyl, alkyl (e.g. cycloalkyl), alkenyl, alkynyl and aryl groups, or a pharmaceutically acceptable salt or derivative thereof. Examples include, but are not limited to: casuarine, casuarine-6-α-D-glucopyranose, 3-epi-casuarine, 7-epi-casuarine, 3,7-diepi-casuarine, etc.

A CD1d ligand, such as an α-glycosylceramide [193-200] (e.g. α-galactosylceramide), phytosphingosine-containing α-glycosylceramides, OCH, KRN7000 [(2S,3S,4R)-1-O-(α-D-galactopyranosyl)-2-(N-hexacosanoylamino)-1,3,4-octadecanetriol], CRONY-101, 3"-O-sulfo-galactosylceramide, etc.

A gamma inulin [201] or derivative thereof, such as algammulin.

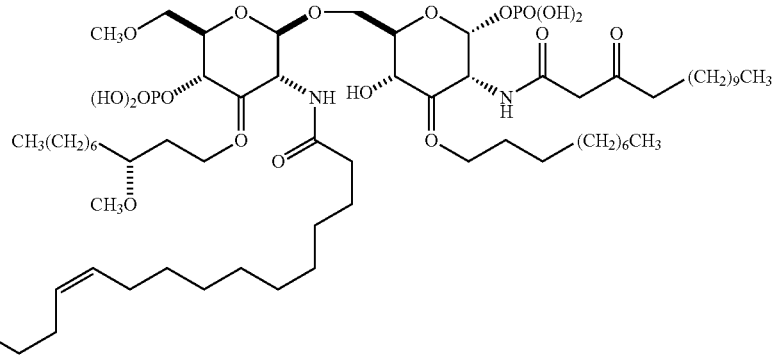

Adjuvant Combinations

The invention may also comprise combinations of one or more of the adjuvants identified above. For example, the following adjuvant compositions may be used in the invention: (1) a saponin and an oil-in-water emulsion [202]; (2) a saponin (e.g. QS21)+a non-toxic LPS derivative (e.g. 3dMPL) [203]; (3) a saponin (e.g. QS21)+a non-toxic LPS derivative (e.g. 3dMPL)+a cholesterol; (4) a saponin (e.g. QS21)+3dMPL+IL-12 (optionally +a sterol) [204]; (5) combinations of 3dMPL with, for example, QS21 and/or oil-in-water emulsions [205]; (6) SAF, containing 10% squalane, 0.4% Tween 80™, 5% pluronic-block polymer L121, and thr-MDP, either microfluidized into a submicron emulsion or vortexed to generate a larger particle size emulsion. (7) Ribi™ adjuvant system (RAS), (Ribi Immunochem) containing 2% squalene, 0.2% Tween 80, and one or more bacterial cell wall components from the group consisting of monophosphorylipid A (MPL), trehalose dimycolate (TDM), and cell wall skeleton (CWS), preferably MPL+CWS (Detox™); and (8) one or more mineral salts (such as an aluminum salt)+a non-toxic derivative of LPS (such as 3dMPL).

Other substances that act as immunostimulating agents are disclosed in chapter 7 of ref. 82.

The use of an aluminium hydroxide and/or aluminium phosphate adjuvant is particularly preferred, and antigens are generally adsorbed to these salts. Calcium phosphate is another preferred adjuvant. Other preferred adjuvant combinations include combinations of Th1 and Th2 adjuvants such as CpG & alum or resiquimod & alum. A combination of aluminium phosphate and 3dMPL may be used.

The compositions of the invention may elicit both a cell mediated immune response as well as a humoral immune response. This immune response will preferably induce long lasting (e.g. neutralising) antibodies and a cell mediated immunity that can quickly respond upon exposure to pnuemococcus.

Two types of T cells, CD4 and CD8 cells, are generally thought necessary to initiate and/or enhance cell mediated immunity and humoral immunity. CD8 T cells can express a CD8 co-receptor and are commonly referred to as Cytotoxic T lymphocytes (CTLs). CD8 T cells are able to recognized or interact with antigens displayed on MHC Class I molecules.

CD4 T cells can express a CD4 co-receptor and are commonly referred to as T helper cells. CD4 T cells are able to recognize antigenic peptides bound to MHC class II molecules. Upon interaction with a MHC class II molecule, the CD4 cells can secrete factors such as cytokines. These secreted cytokines can activate B cells, cytotoxic T cells, macrophages, and other cells that participate in an immune response. Helper T cells or CD4+ cells can be further divided into two functionally distinct subsets: TH1 phenotype and TH2 phenotypes which differ in their cytokine and effector function.

Activated TH1 cells enhance cellular immunity (including an increase in antigen-specific CTL production) and are therefore of particular value in responding to intracellular infections. Activated TH1 cells may secrete one or more of IL-2, IFN-γ, and TNF-β. A TH1 immune response may result in local inflammatory reactions by activating macrophages, NK (natural killer) cells, and CD8 cytotoxic T cells (CTLs). A TH1 immune response may also act to expand the immune response by stimulating growth of B and T cells with IL-12. TH1 stimulated B cells may secrete IgG2a.

Activated TH2 cells enhance antibody production and are therefore of value in responding to extracellular infections. Activated TH2 cells may secrete one or more of IL-4, IL-5, IL-6, and IL-10. A TH2 immune response may result in the production of IgG1, IgE, IgA and memory B cells for future protection.

An enhanced immune response may include one or more of an enhanced TH1 immune response and a TH2 immune response.

A TH1 immune response may include one or more of an increase in CTLs, an increase in one or more of the cytokines associated with a TH1 immune response (such as IL-2, IFN-γ, and TNF-β), an increase in activated macrophages, an increase in NK activity, or an increase in the production of IgG2a. Preferably, the enhanced TH1 immune response will include an increase in IgG2a production.

A TH1 immune response may be elicited using a TH1 adjuvant. A TH1 adjuvant will generally elicit increased levels of IgG2a production relative to immunization of the antigen without adjuvant. TH1 adjuvants suitable for use in the invention may include for example saponin formulations, virosomes and virus like particles, non-toxic derivatives of enterobacterial lipopolysaccharide (LPS), immunostimulatory oligonucleotides. Immunostimulatory oligonucleotides, such as oligonucleotides containing a CpG motif, are preferred TH1 adjuvants for use in the invention.

A TH2 immune response may include one or more of an increase in one or more of the cytokines associated with a TH2 immune response (such as IL-4, IL-5, IL-6 and IL-10), or an increase in the production of IgG1, IgE, IgA and memory B cells. Preferably, the enhanced TH2 immune response will include an increase in IgG1 production.

A TH2 immune response may be elicited using a TH2 adjuvant. A TH2 adjuvant will generally elicit increased levels of IgG1 production relative to immunization of the antigen without adjuvant. TH2 adjuvants suitable for use in the invention include, for example, mineral containing compositions, oil-emulsions, and ADP-ribosylating toxins and detoxified derivatives thereof. Mineral containing compositions, such as aluminium salts are preferred TH2 adjuvants for use in the invention.

Preferably, the invention includes a composition comprising a combination of a TH1 adjuvant and a TH2 adjuvant. Preferably, such a composition elicits an enhanced TH1 and an enhanced TH2 response, i.e., an increase in the production of both IgG1 and IgG2a production relative to immunization without an adjuvant. Still more preferably, the composition comprising a combination of a TH1 and a TH2 adjuvant elicits an increased TH1 and/or an increased TH2 immune response relative to immunization with a single adjuvant (i.e., relative to immunization with a TH1 adjuvant alone or immunization with a TH2 adjuvant alone).

The immune response may be one or both of a TH1 immune response and a TH2 response. Preferably, immune response provides for one or both of an enhanced TH1 response and an enhanced TH2 response.

The enhanced immune response may be one or both of a systemic and a mucosal immune response. Preferably, the immune response provides for one or both of an enhanced systemic and an enhanced mucosal immune response. Preferably the mucosal immune response is a TH2 immune response. Preferably, the mucosal immune response includes an increase in the production of IgA.

*S. aureus* infections can affect various areas of the body and so the compositions of the invention may be prepared in various forms. For example, the compositions may be prepared as injectables, either as liquid solutions or suspensions. Solid forms suitable for solution in, or suspension in, liquid vehicles prior to injection can also be prepared (e.g. a lyophilised composition or a spray-freeze dried composition). The composition may be prepared for topical administration e.g. as an ointment, cream or powder. The composition may be prepared for oral administration e.g. as a tablet or capsule, as a spray, or as a syrup (optionally flavoured). The composition may be prepared for pulmonary administration e.g. as an inhaler, using a fine powder or a spray. The composition may be prepared as a suppository or pessary. The composition may be prepared for nasal, aural or ocular administration e.g. as drops. The composition may be in kit form, designed such that a combined composition is reconstituted just prior to administration to a patient. Such kits may comprise one or more antigens in liquid form and one or more lyophilised antigens.

Where a composition is to be prepared extemporaneously prior to use (e.g. where a component is presented in lyophilised form) and is presented as a kit, the kit may comprise two vials, or it may comprise one ready-filled syringe and one vial, with the contents of the syringe being used to reactivate the contents of the vial prior to injection.

Immunogenic compositions used as vaccines comprise an immunologically effective amount of antigen(s), as well as any other components, as needed. By 'immunologically effective amount', it is meant that the administration of that amount to an individual, either in a single dose or as part of a series, is effective for treatment or prevention. This amount varies depending upon the health and physical condition of the individual to be treated, age, the taxonomic group of individual to be treated (e.g. non-human primate, primate, etc.), the capacity of the individual's immune system to synthesise antibodies, the degree of protection desired, the formulation of the vaccine, the treating doctor's assessment of the medical situation, and other relevant factors. It is expected that the amount will fall in a relatively broad range that can be determined through routine trials. Where more than one antigen is included in a composition then two antigens may be present at the same dose as each other or at different doses.

As mentioned above, a composition may include a temperature protective agent, and this component may be particularly useful in adjuvanted compositions (particularly those containing a mineral adjuvant, such as an aluminium salt). As described in reference 206, a liquid temperature protective agent may be added to an aqueous vaccine composition to lower its freezing point e.g. to reduce the freezing point to below 0° C. Thus the composition can be stored below 0° C., but above its freezing point, to inhibit thermal breakdown. The temperature protective agent also permits freezing of the composition while protecting mineral salt adjuvants against agglomeration or sedimentation after freezing and thawing, and may also protect the composition at elevated temperatures e.g. above 40° C. A starting aqueous vaccine and the liquid temperature protective agent may be mixed such that the liquid temperature protective agent forms from 1-80% by volume of the final mixture. Suitable temperature protective agents should be safe for human administration, readily miscible/soluble in water, and should not damage other components (e.g. antigen and adjuvant) in the composition. Examples include glycerin, propylene glycol, and/or polyethylene glycol (PEG). Suitable PEGs may have an average molecular weight ranging from 200-20,000 Da. In a preferred embodiment, the polyethylene glycol can have an average molecular weight of about 300 Da ('PEG-300').

The invention provides an immunogenic composition comprising: (i) one or more antigen(s) selected from the first, second, third or fourth antigen groups; and (ii) a temperature protective agent. The invention further provides an immunogenic composition comprising: (i) a loop-deleted Hla polypeptide and optionally one or more antigen(s) selected from the first, second, third or fourth antigen groups; and (ii) a temperature protective agent. The invention further provides an immunogenic composition comprising: (i) a Hla polypeptide having a mutation of the tyrosine residue corresponding to amino acid 101 of SEQ ID NO: 231 and optionally one or more antigen(s) selected from the first, second, third or fourth antigen groups; and (ii) a temperature protective agent. These compositions may be formed by mixing (i) an aqueous composition comprising one or more antigen(s) selected from the first, second, third or fourth antigen groups and/or a loop-deleted Hla polypeptide and/or a Hla polypeptide having a mutation of the tyrosine residue corresponding to amino acid 101 of SEQ ID NO: 231, with (ii) a temperature protective agent. The mixture may then be stored e.g. below 0° C., from 0-20° C., from 20-35° C., from 35-55° C., or higher. It may be stored in liquid or frozen form. The mixture may be lyophilised. The composition may alternatively be formed by mixing (i) a dried composition comprising one or more antigen(s) selected from the first, second, third or fourth antigen groups and/or a loop-deleted Hla polypeptide and/or a Hla polypeptide having a mutation of the tyrosine residue corresponding to amino acid 101 of SEQ ID NO: 231, with (ii) a liquid composition comprising the temperature protective agent. Thus component (ii) can be used to reconstitute component (i).

Methods of Treatment, and Administration of the Vaccine

The invention also provides a method for raising an immune response in a mammal comprising the step of administering an effective amount of a composition of the invention. The immune response is preferably protective and preferably involves antibodies and/or cell-mediated immunity. The method may raise a booster response.

The invention also provides at least two antigens of the invention for combined use as a medicament e.g. for use in raising an immune response in a mammal.

The invention also provides the use of at least two antigens of the invention in the manufacture of a medicament for raising an immune response in a mammal.

By raising an immune response in the mammal by these uses and methods, the mammal can be protected against *S. aureus* infection, including a nosocomial infection. More particularly, the mammal may be protected against a skin infection, pneumonia, meningitis, osteomyelitis endocarditis, toxic shock syndrome, and/or septicaemia.

The invention also provides a kit comprising a first component and a second component wherein neither the first component nor the second component is a composition of the invention as described above, but wherein the first component and the second component can be combined to provide a composition of the invention as described above. The kit may further include a third component comprising one or more of the following: instructions, syringe or other delivery device, adjuvant, or pharmaceutically acceptable formulating solution.

The invention also provides a delivery device pre-filled with an immunogenic composition of the invention.

The mammal is preferably a human. Where the vaccine is for prophylactic use, the human is preferably a child (e.g. a toddler or infant) or a teenager; where the vaccine is for therapeutic use, the human is preferably a teenager or an adult. A vaccine intended for children may also be administered to adults e.g. to assess safety, dosage, immunogenicity, etc. Other mammals which can usefully be immunised according to the invention are cows, dogs, horses, and pigs.

One way of checking efficacy of therapeutic treatment involves monitoring *S. aureus* infection after administration of the compositions of the invention. One way of checking efficacy of prophylactic treatment involves monitoring immune responses, systemically (such as monitoring the level of IgG1 and IgG2a production) and/or mucosally (such as monitoring the level of IgA production), against the antigens in the compositions of the invention after administration of the composition. Typically, antigen-specific serum antibody responses are determined post-immunisation but pre-challenge whereas antigen-specific mucosal antibody responses are determined post-immunisation and post-challenge.

Another way of assessing the immunogenicity of the compositions of the present invention is to express the proteins recombinantly for screening patient sera or mucosal secretions by immunoblot and/or microarrays. A positive reaction between the protein and the patient sample indicates that the patient has mounted an immune response to the protein in question. This method may also be used to identify immunodominant antigens and/or epitopes within antigens.

The efficacy of vaccine compositions can also be determined in vivo by challenging animal models of *S. aureus* infection, e.g., guinea pigs or mice, with the vaccine compositions. In particular, there are three useful animal models for the study of *S. aureus* infectious disease, namely: (i) the murine abscess model [207], (ii) the murine lethal infection model [207] and (iii) the murine pneumonia model [208]. The abscess model looks at abscesses in mouse kidneys after intravenous challenge. The lethal infection model looks at the number of mice which survive after being infected by a normally-lethal dose of *S. aureus* by the intravenous or intraperitoneal route. The pneumonia model also looks at the survival rate, but uses intranasal infection. A useful vaccine may be effective in one or more of these models. For instance, for some clinical situations it may be desirable to protect against pneumonia, without needing to prevent hematic spread or to promote opsonisation; in other situations the main desire may be to prevent hematic spread. Different antigens, and different antigen combinations, may contribute to different aspects of an effective vaccine.

Compositions of the invention will generally be administered directly to a patient. Direct delivery may be accomplished by parenteral injection (e.g. subcutaneously, intraperitoneally, intravenously, intramuscularly, or to the interstitial space of a tissue), or mucosally, such as by rectal, oral (e.g. tablet, spray), vaginal, topical, transdermal or transcutaneous, intranasal, ocular, aural, pulmonary or other mucosal administration.

The invention may be used to elicit systemic and/or mucosal immunity, preferably to elicit an enhanced systemic and/or mucosal immunity.

Preferably the enhanced systemic and/or mucosal immunity is reflected in an enhanced TH1 and/or TH2 immune response. Preferably, the enhanced immune response includes an increase in the production of IgG 1 and/or IgG2a and/or IgA.

Dosage can be by a single dose schedule or a multiple dose schedule. Multiple doses may be used in a primary immunisation schedule and/or in a booster immunisation schedule. In a multiple dose schedule the various doses may be given by the same or different routes e.g. a parenteral prime and mucosal boost, a mucosal prime and parenteral boost, etc. Multiple doses will typically be administered at least 1 week apart (e.g. about 2 weeks, about 3 weeks, about 4 weeks, about 6 weeks, about 8 weeks, about 10 weeks, about 12 weeks, about 16 weeks, etc.).

Vaccines prepared according to the invention may be used to treat both children and adults. Thus a human patient may be less than 1 year old, 1-5 years old, 5-15 years old, 15-55 years old, or at least 55 years old. Preferred patients for receiving the vaccines are the elderly (e.g. ≥50 years old, ≥60 years old, and preferably ≥65 years), the young (e.g. ≤5 years old), hospitalised patients, healthcare workers, armed service and military personnel, pregnant women, the chronically ill, or immunodeficient patients. The vaccines are not suitable solely for these groups, however, and may be used more generally in a population.

Vaccines produced by the invention may be administered to patients at substantially the same time as (e.g. during the same medical consultation or visit to a healthcare professional or vaccination centre) other vaccines e.g. at substantially the same time as an influenza vaccine, a measles vaccine, a mumps vaccine, a rubella vaccine, a MMR vaccine, a varicella vaccine, a MMRV vaccine, a diphtheria vaccine, a tetanus vaccine, a pertussis vaccine, a DTP vaccine, a conjugated *H. influenzae* type b vaccine, an inactivated poliovirus vaccine, a hepatitis B virus vaccine, a meningococcal conjugate vaccine (such as a tetravalent A-C-W135-Y vaccine), a respiratory syncytial virus vaccine, etc. Further non-staphylococcal vaccines suitable for co-administration may include one or more antigens listed on pages 33-46 of reference 51.

Nucleic Acid Immunisation

The immunogenic compositions described above include polypeptide antigens from *S. aureus*. In all cases, however, the polypeptide antigens can be replaced by nucleic acids (typically DNA) encoding those polypeptides, to give compositions, methods and uses based on nucleic acid immunisation. Nucleic acid immunisation is now a developed field (e.g. see references 209 to 216 etc.).

The nucleic acid encoding the immunogen is expressed in vivo after delivery to a patient and the expressed immunogen then stimulates the immune system. The active ingredient will typically take the form of a nucleic acid vector comprising: (i) a promoter; (ii) a sequence encoding the immunogen, operably linked to the promoter; and optionally (iii) a selectable marker. Preferred vectors may further comprise (iv) an origin of replication; and (v) a transcription terminator downstream of and operably linked to (ii). In general, (i) & (v) will be eukaryotic and (iii) & (iv) will be prokaryotic.

Preferred promoters are viral promoters e.g. from cytomegalovirus (CMV). The vector may also include transcriptional regulatory sequences (e.g. enhancers) in addition to the promoter and which interact functionally with the promoter. Preferred vectors include the immediate-early CMV enhancer/promoter, and more preferred vectors also include CMV intron A. The promoter is operably linked to a downstream sequence encoding an immunogen, such that expression of the immunogen-encoding sequence is under the promoter's control.

Where a marker is used, it preferably functions in a microbial host (e.g. in a prokaryote, in a bacteria, in a yeast). The marker is preferably a prokaryotic selectable marker (e.g. transcribed under the control of a prokaryotic promoter). For convenience, typical markers are antibiotic resistance genes.

The vector of the invention is preferably an autonomously replicating episomal or extrachromosomal vector, such as a plasmid.

The vector of the invention preferably comprises an origin of replication. It is preferred that the origin of replication is active in prokaryotes but not in eukaryotes.

Preferred vectors thus include a prokaryotic marker for selection of the vector, a prokaryotic origin of replication, but a eukaryotic promoter for driving transcription of the immunogen-encoding sequence. The vectors will therefore (a) be amplified and selected in prokaryotic hosts without polypeptide expression, but (b) be expressed in eukaryotic hosts without being amplified. This arrangement is ideal for nucleic acid immunization vectors.

The vector of the invention may comprise a eukaryotic transcriptional terminator sequence downstream of the coding sequence. This can enhance transcription levels. Where the coding sequence does not have its own, the vector of the invention preferably comprises a polyadenylation sequence. A preferred polyadenylation sequence is from bovine growth hormone.

The vector of the invention may comprise a multiple cloning site

In addition to sequences encoding the immunogen and a marker, the vector may comprise a second eukaryotic coding sequence. The vector may also comprise an IRES upstream of said second sequence in order to permit translation of a second eukaryotic polypeptide from the same transcript as the immunogen. Alternatively, the immunogen-coding sequence may be downstream of an IRES.

The vector of the invention may comprise unmethylated CpG motifs e.g. unmethylated DNA sequences which have in common a cytosine preceding a guanosine, flanked by two 5' purines and two 3' pyrimidines. In their unmethylated form these DNA motifs have been demonstrated to be potent stimulators of several types of immune cell.

Vectors may be delivered in a targeted way. Receptor-mediated DNA delivery techniques are described in, for example, references 217 to 222. Therapeutic compositions containing a nucleic acid are administered in a range of about 100 ng to about 200 mg of DNA for local administration in a gene therapy protocol. Concentration ranges of about 500 ng to about 50 mg, about 1 mg to about 2 mg, about 5 μs to about 500 μg, and about 20 μg to about 100 μg of DNA can also be used during a gene therapy protocol. Factors such as method of action (e.g. for enhancing or inhibiting levels of the encoded gene product) and efficacy of transformation and expression are considerations which will affect the dosage required for ultimate efficacy. Where greater expression is desired over a larger area of tissue, larger amounts of vector or the same amounts re-administered in a successive protocol of administrations, or several administrations to different adjacent or close tissue portions may be required to effect a positive therapeutic outcome. In all cases, routine experimentation in clinical trials will determine specific ranges for optimal therapeutic effect.

Vectors can be delivered using gene delivery vehicles. The gene delivery vehicle can be of viral or non-viral origin (see generally references 223 to 226).

Viral-based vectors for delivery of a desired nucleic acid and expression in a desired cell are well known in the art. Exemplary viral-based vehicles include, but are not limited to, recombinant retroviruses (e.g. references 227 to 237), alphavirus-based vectors (e.g. Sindbis virus vectors, Semliki forest virus (ATCC VR-67; ATCC VR-1247), Ross River virus (ATCC VR-373; ATCC VR-1246) and Venezuelan equine encephalitis virus (ATCC VR-923; ATCC VR-1250; ATCC VR 1249; ATCC VR-532); hybrids or chimeras of these viruses may also be used), poxvirus vectors (e.g. vaccinia, fowlpox, canarypox, modified vaccinia Ankara, etc.), adenovirus vectors, and adeno-associated virus (AAV) vectors (e.g. see refs. 238 to 243). Administration of DNA linked to killed adenovirus [244] can also be employed.

Non-viral delivery vehicles and methods can also be employed, including, but not limited to, polycationic condensed DNA linked or unlinked to killed adenovirus alone [e.g. 244], ligand-linked DNA [245], eukaryotic cell delivery vehicles cells [e.g. refs. 246 to 250] and nucleic charge neutralization or fusion with cell membranes. Naked DNA can also be employed. Exemplary naked DNA introduction methods are described in refs. 251 and 252. Liposomes (e.g. immunoliposomes) that can act as gene delivery vehicles are described in refs. 253 to 257. Additional approaches are described in references 258 & 259.

Further non-viral delivery suitable for use includes mechanical delivery systems such as the approach described in ref. 259. Moreover, the coding sequence and the product of expression of such can be delivered through deposition of photopolymerized hydrogel materials or use of ionizing radiation [e.g. refs. 260 & 261]. Other conventional methods for gene delivery that can be used for delivery of the coding sequence include, for example, use of hand-held gene transfer particle gun [262] or use of ionizing radiation for activating transferred genes [260 & 261].

Delivery DNA using PLG {poly(lactide-co-glycolide)} microparticles is a particularly preferred method e.g. by adsorption to the microparticles, which are optionally treated to have a negatively-charged surface (e.g. treated with SDS) or a positively-charged surface (e.g. treated with a cationic detergent, such as CTAB).

*S. epidermidis*

Although the invention focuses on *S. aureus*, the inventors also realise that the sta006 and sta011 antigens have homologs in *S. epidermidis*. For example, SEQ ID NO: 234 is the 'iron (Fe+3) ABC superfamily ATP binding cassette transporter, binding protein' from *S. epidermidis* strain M23864:W1, with 73% identity to SEQ ID NO: 42 (sta006), and SEQ ID NO: 235 is the 'putative lipoprotein' from *S. epidermidis* strain RP62A, with 67% identity to SEQ ID NO: 47 (sta011).

*S. epidermidis* is commonly present on human skin and can sometimes cause illness. Infection is usually associated with medical devices, such as catheters, and is a cause of nosocomial infections. The results disclosed herein for sta006 and sta011 against *S. aureus* suggest that the homologous proteins in *S. epidermis* could be useful for immunising against this pathogen.

The invention provides an immunogenic composition comprising:
(i) a polypeptide comprising an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 234; and/or (b) comprising a fragment of at least 'n' consecutive amino acids of SEQ ID NO: 234, wherein 'n' is 7 or more (e.g. 8, 10, 12, 14, 16, 18, 20, 25, 30, 35, 40, 50, 60, 70, 80, 90, 100, 150, 200, 250 or more);
and/or
(ii) a polypeptide comprising an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 235; and/or (b) comprising a fragment of at least 'n' consecutive amino acids of SEQ ID NO: 235, wherein 'n' is 7 or more (e.g. 8, 10, 12, 14, 16, 18, 20, 25, 30, 35, 40, 50, 60, 70, 80, 90, 100, 150, 200, 250 or more).

The composition may also include an adjuvant. These compositions are particularly useful for immunising a mammal (including a human) against *S. epidermis* infection.

Preferred fragments of (b) comprise an epitope from SEQ ID NO: 234 or 235, respectively. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 234/235 while retaining at least one epitope of SEQ ID NO: 234/235.

More generally, the invention provides the use of the sta006 and/or sta011 homolog from any *Staphylococcus* species for immunising a mammal against that species.

Antibodies

Antibodies against *S. aureus* antigens can be used for passive immunisation. Thus the invention provides an antibody which is specific for an antigen in the first, second, third or fourth antigen groups. Thus the invention further provides an antibody which is specific for a loop-deleted Hla polypeptide. The invention further provides an antibody which is specific for a Hla polypeptide having a mutation of the tyrosine residue corresponding to amino acid 101 of SEQ ID NO: 231. The invention also provides the use of such antibodies in therapy. The invention also provides the use of such antibodies in the manufacture of a medicament. The invention also provides a method for treating a mammal comprising the step of administering an effective amount of an antibody of the invention. As described above for immunogenic compositions, these methods and uses allow a mammal to be protected against *S. aureus* infection.

The term "antibody" includes intact immunoglobulin molecules, as well as fragments thereof which are capable of binding an antigen. These include hybrid (chimeric) antibody molecules [263, 264]; F(ab')2 and F(ab) fragments and Fv molecules; non-covalent heterodimers [265, 266]; single-chain Fv molecules (sFv) [267]; dimeric and trimeric antibody fragment constructs; minibodies [268, 269]; humanized antibody molecules [270-272]; and any functional fragments obtained from such molecules, as well as antibodies obtained through non-conventional processes such as phage display. Preferably, the antibodies are monoclonal antibodies. Methods of obtaining monoclonal antibodies are well known in the art. Humanised or fully-human antibodies are preferred.

General

The practice of the present invention will employ, unless otherwise indicated, conventional methods of chemistry, biochemistry, molecular biology, immunology and pharmacology, within the skill of the art. Such techniques are explained fully in the literature. See, e.g., references 273-280, etc.

"GI" numbering is used above. A GI number, or "GenInfo Identifier", is a series of digits assigned consecutively to each sequence record processed by NCBI when sequences are added to its databases. The GI number bears no resemblance to the accession number of the sequence record. When a sequence is updated (e.g. for correction, or to add more annotation or information) then it receives a new GI number. Thus the sequence associated with a given GI number is never changed.

Where the invention concerns an "epitope", this epitope may be a B-cell epitope and/or a T-cell epitope. Such epitopes can be identified empirically (e.g. using PEPSCAN [281,282] or similar methods), or they can be predicted (e.g. using the Jameson-Wolf antigenic index [283], matrix-based approaches [284], MAPITOPE [285], TEPITOPE [286,287], neural networks [288], OptiMer & EpiMer [289, 290], ADEPT [291], Tsites [292], hydrophilicity [293], antigenic index [294] or the methods disclosed in references 295-299, etc.). Epitopes are the parts of an antigen that are recognised by and bind to the antigen binding sites of antibodies or T-cell receptors, and they may also be referred to as "antigenic determinants".

Where an antigen "domain" is omitted, this may involve omission of a signal peptide, of a cytoplasmic domain, of a transmembrane domain, of an extracellular domain, etc.

The term "comprising" encompasses "including" as well as "consisting" e.g. a composition "comprising" X may consist exclusively of X or may include something additional e.g. X+Y.

The term "about" in relation to a numerical value x is optional and means, for example, x±10%.

References to a percentage sequence identity between two amino acid sequences means that, when aligned, that percentage of amino acids are the same in comparing the two sequences. This alignment and the percent homology or sequence identity can be determined using software programs known in the art, for example those described in section 7.7.18 of ref. 300. A preferred alignment is determined by the Smith-Waterman homology search algorithm using an affine gap search with a gap open penalty of 12 and a gap extension penalty of 2, BLOSUM matrix of 62. The Smith-Waterman homology search algorithm is disclosed in ref. 301.

The region of a polypeptide of interest which "corresponds" or is "corresponding" to a region of a reference polypeptide may be determined by aligning the amino acid sequence of the polypeptide of interest with the amino acid sequence of the reference polypeptide. Alignment of polypeptide sequences may be performed as described above. Amino acids which align with each other during the alignment of the sequences may be referred to as "corresponding" to each other. In some cases, the sequence of interest will not have one or more amino acids to align to one or more amino acids of the reference sequence. In such circumstances, the sequence of interest is said to lack one or more amino acids corresponding to the relevant region of the reference polypeptide.

BRIEF DESCRIPTION OF DRAWINGS

In FIG. 2, the six groups from SA-10-a are, from top to bottom at day 14. groups (i), (iii) & (iv) together, (ii), IsdB, then the negative control. In FIG. 3, the six groups from SA-10-a are, from top to bottom at day 14. groups (i), (iii) & (iv) together, (ii), IsdB, then the negative control. In FIG. 3, the six groups from SA-10-b are, from top to bottom at day 14. groups (iii), (i), (iv), (ii) and IsdB together, then the negative control. In FIG. 4, the six groups from SA-14 are, from top to bottom at day 14. groups (iv), (ii), (i), (iii), negative control, and IsdB.

FIG. 7 shows bacterial count (log CFU/ml) in kidneys of mice in an abscess model experiment. Mice were challenged with the following strains: (A) MW2; (B) LAC; (C) Staph19; or (D) MU50. Each point is an individual animal and the bar shows the median count per group. Mice had been immunised as shown on the x-axis label.

FIG. 9 shows IgG titers against (A) EsxAB (B) Sta006 (C) Hla-H35L (D) Sta011. Each graph has three groups, with a pair of bars per group. The right-hand bar in a pair shows pre-immune IgG and the left-hand bar shows post-immune IgG. The three groups are the compositions used for immunising and, from left to right, are: negative control of adjuvant alone; the Combo1 combination; and the relevant antigen alone.

FIG. 18 shows an alignment of the Hla-PSGS polypeptide of SEQ ID NO: 216 with the polypeptide of SEQ ID NO: 14. In each aligned pair, the top sequence is the from SEQ ID NO: 216, and the bottom sequence is from SEQ ID NO: 14. The amino acid residue numbers for each sequence are indicated along with the sequences. As shown in the alignment, SEQ ID NO: 216 lacks 35 amino acids from the stem-like structure corresponding to amino acids 136-174 of SEQ ID NO: 14.

Figure 19:
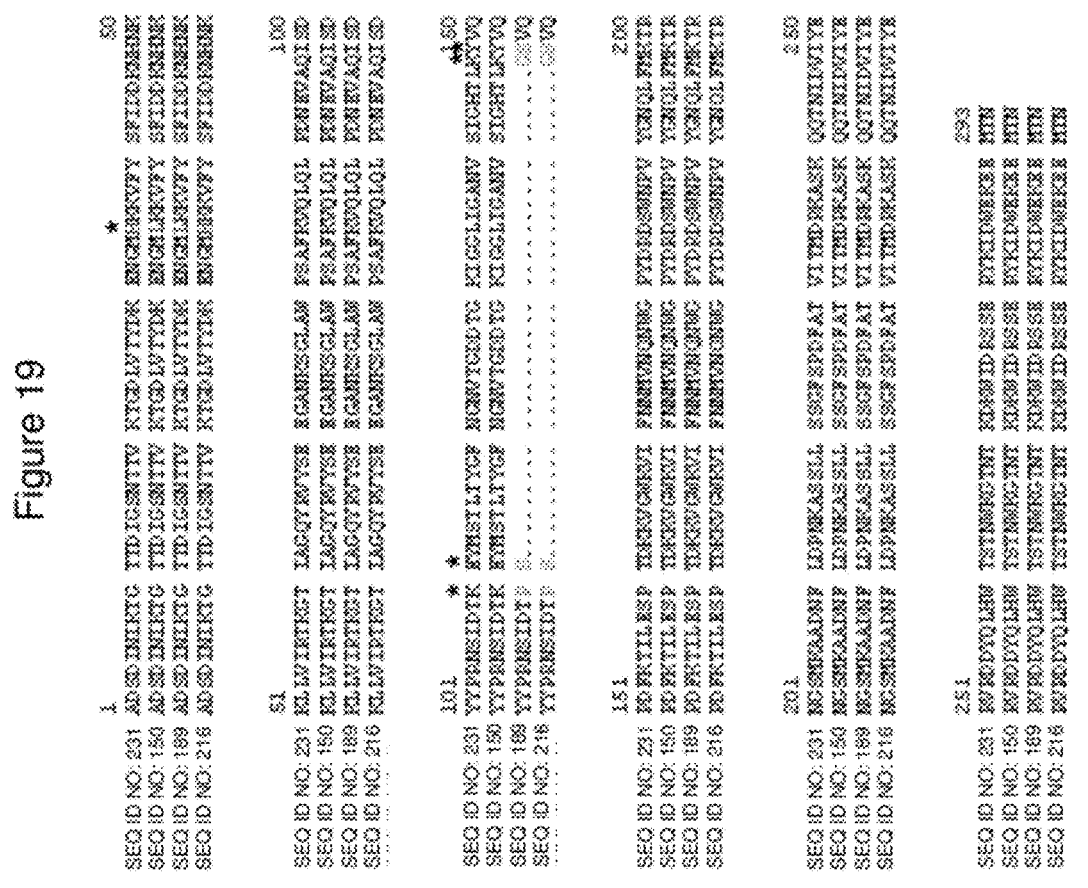

FIG. 19 shows an alignment of SEQ ID NOs: 231, 150, 189, and 219. Each of these sequences is described earlier in the present application.

FIG. 22 shows transmission electron microscopy (TEM) images of negative stained (A) human ghost membrane, (B) wild-type Hla on human ghost membrane, (C) Hla-PSGS on human ghost membrane, (D) HlaH35L on human ghost membrane, (E) Hla WT, (F) Hla-PSGS, (→=exemplary images used for the Single Particle Reconstruction), (G) HlaH35L.

MODES FOR CARRYING OUT THE INVENTION

Antigen Selection

Figure 1:
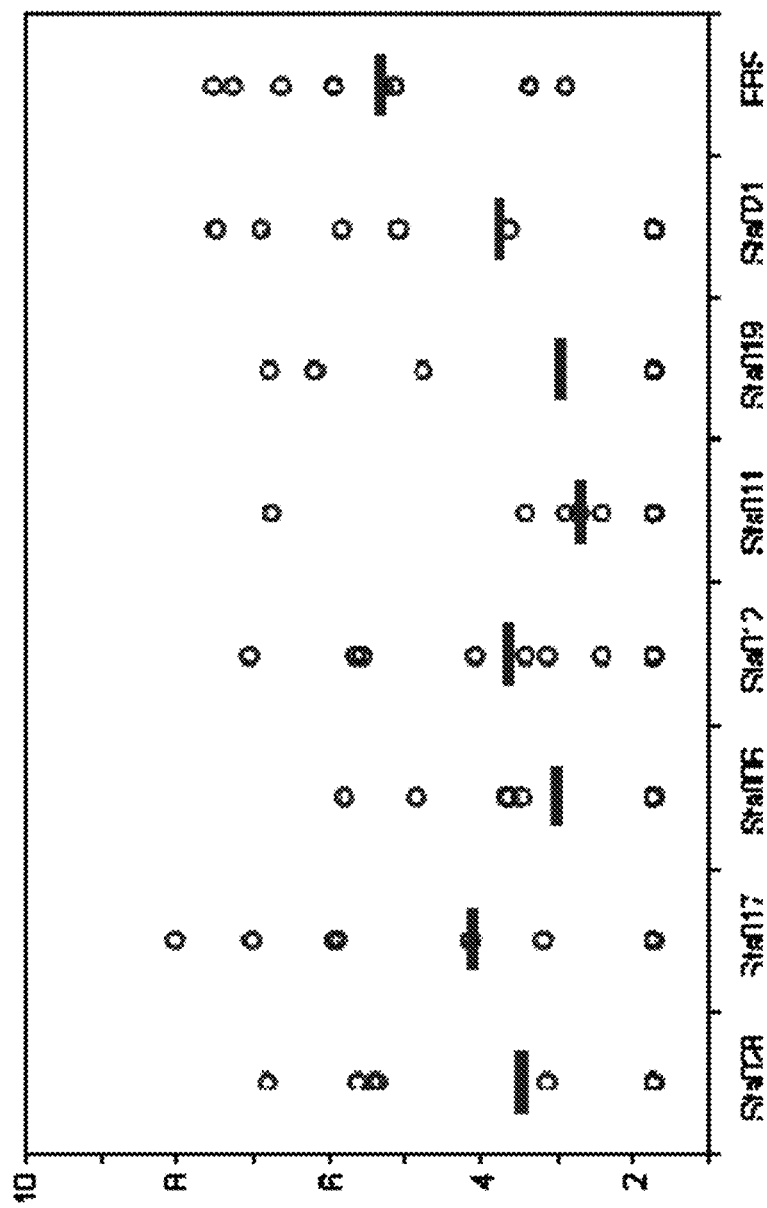
FIG. 1 shows bacterial counts (Log cfu/ml) after challenge of mice previously immunised with the indicated antigens.

S. aureus proteins have been selected for use as vaccine components based on various criteria.

IsdA is a surface protein involved in iron uptake. It is detectable with a high molecular weight (>250 kDa) in immunoblots of whole cell lysates and cell wall fractions of S. aureus. Furthermore, labelled anti-IsdA antibodies revealed extracellular structures. These structures were seen in a variety of growth and infection conditions, including iron positive conditions (in which IsdA expression is reported to be suppressed). The structures have a tail up to 4 μm long, with a typical orientation parallel to the mammalian cell surface. Detached IsdA-positive structures were observed to adhere on the surface of epithelial cells, but lose cell junction localization. Epithelia/bacteria interaction may stimulate expression of the structures. In addition, the inventors have found that IsdA is well conserved between different strains (present in 36/36 strains tested; see below), thus offering protection across a broad population of circulating strains. Iron uptake is important for virulence, so the protein is likely to be available for immune attack at pathological stages of the bacterial life cycle. The inventors have found that the protein is not cytotoxic to human cells (see below). The protein can also adsorb reasonably well to aluminium hydroxide (see below), which is useful for stable formulation for delivery to humans. It is useful for providing an immune response to prevent hematic spread of the bacterium.

EsxA and EsxB are small acidic dimeric secreted proteins. The inventors have found that EsxA is highly conserved between different strains (present in 36/36 strains tested; see below), while EsxB is present in 25/36 strains. The proteins are involved in persisting an infection and so are likely to be available for immune attack at pathological stages of the bacterial life cycle. The inventors have found that a fusion of EsxA and EsxB ('EsxAB') is not cytotoxic to human cells (see below). It can also adsorb well to aluminium hydroxide (see below), which is useful for stable formulation for delivery to humans. Thus the antigens are useful for providing an immune response to prevent hematic spread of the bacterium.

Hla is a pore-forming secreted toxin. This protein is well conserved between different strains (present in 36/36 strains tested; see below), thus offering protection across a broad population of circulating strains. It is an important virulence factor so is likely to be available for immune attack at pathological stages of the bacterial life cycle. It is not cytotoxic to human cells (see below). The protein can adsorb reasonably well to aluminium hydroxide (see below), which is useful for stable formulation for delivery to humans. It is useful for providing an immune response to prevent pneumonia.

Spa is a surface protein involved in Fc binding. The inventors have found that this protein is well conserved between different strains (present in 36/36 strains tested), thus offering protection across a broad population of circulating strains. It is important for virulence so is likely to be available for immune attack at pathological stages of the bacterial life cycle. The protein can also adsorb reasonably well to aluminium hydroxide (see below), which is useful for stable formulation for delivery to humans. It is useful for providing an immune response to prevent hematic spread of the bacterium.

Sta006 (also known as FhuD2) is a surface protein involved in iron uptake. The inventors have found that this protein is well conserved between different strains (present in 36/36 strains tested; see below), thus offering protection across a broad population of circulating strains. The inventors have found that the protein is not cytotoxic to human cells (see below). The protein can also adsorb well to aluminium hydroxide (see below), which is useful for stable formulation for delivery to humans. It is useful for providing an immune response to prevent hematic spread of the bacterium.

Sta011 is a surface lipoprotein. The inventors have found that this protein is well conserved between different strains (present in 36/36 strains tested; see below), thus offering protection across a broad population of circulating strains. The inventors have found that the protein is not cytotoxic to human cells (see below). The protein can also adsorb reasonably well to aluminium hydroxide (see below), which is useful for stable formulation for delivery to humans. It is useful for providing an immune response to prevent hematic spread of the bacterium. This protein has been shown to assemble into oligomers in the presence of $Ca^{++}$ ions, but not $Mg^{++}$ ions (see FIG. 8). These experiments used 5 μg recombinant tag-free Sta011, incubated at 37° C. for 25 minutes with increasing $CaCl_2$ concentrations from 0.5-50 mM, then analysed by gel electrophoresis on a clear native gel. A mobility shift (indicating oligomerisation) was evident from 2 mM $Ca^{++}$, and particularly >5 mM. These levels compare to blood $Ca^{++}$ concentrations of about 1.2 mM, serum concentrations of about 11 mM, and milk concentrations of about 32 mM. EDTA reversed the shift.

Surface digestion [302] and/or analysis of secreted proteins revealed peptide fragments from ClfA, ClfB, coA, eap, ebhA, ebpS, efb, emp, FnBA, FnBB, hla, IsdA, IsdB, lsdH, ukD, lukS, sdrD, sdrE, sasB, sasD, sasF, spa, sta001, sta002, sta003, sta004, sta005, sta006, sta007, sta008, sta009, sta010, sta011, sta019, sta023, sta024, sta028, sta036, sta040, sta049, sta050, sta054, sta057, sta064, sta065, sta073, sta095, sta096, sta098, sta100, sta101, sta102, sta103, sta105, sta107, sta108, sta109, sat111, sta112, sta113, sta115, sta116, sta117, sta118, sta120, NW__06, NW__07, NW__08, NW__09 and NW__10 e.g. SEQ ID NOs: 228 and 229 were identified as fragments of sta019.

Conjugated capsular saccharides are useful for providing opsonic immunity. Serotypes 5 and 8 cover about 85% of clinical isolates.

Strain Coverage

A panel of 36 clinical isolates was used to represent circulating strains, including strains belonging to the five clonal lineages representing the vast majority of worldwide circulating CA-MRSA (community-associated methicillin-resistant *S. aureus*). HA-MRSA (hospital-associated MRSA) and non-MRSA strains were also included. Overall the panel included 9 HA-MRSA strains, 7 CA-MRSA strains, 2 MRSA strains, and 18 other strains.

Genes encoding IsdA, Hla, EsxA, Sta006, Sta011, Spa, and ClfB were present in all 36 strains. The gene for EsxB was absent from 11/36 strains, and the gene for SdrD was absent from 6/36 strains.

The encoded IsdA sequences were 95-100% identical across the panel, and the protein was expressed in iron-limited conditions in the stationary growth phase. The encoded SdrD sequences were 95-100% identical in the 30/36 $SdrD^{+ve}$ panel members. The encoded EsxA sequences were 100% identical across the panel; the encoded EsxB sequences were 95-100% identical in the 25 $EsxB^{+ve}$ strains. The encoded CIfB sequences were 93-100% identical across the panel, and this protein was also found to be highly surface-exposed in the early exponential growth phase.

Conservation in the encoded amino acid sequences were as follows (% identity):

| Antigen | IsdA | ClfB | SdrD | Spa | Hla | EsxA | EsxB | Sta006 |
|---|---|---|---|---|---|---|---|---|
| % | 95-100 | 97-100 | 88-100 | 98-100 | 97-100 | 100 | 95-100 | 99.7-100 |

A larger panel of 61 strains was screened for the presence of genes encoding Hla and Sta006, as well as for their expression. This panel covered both MRSA and MSSA strains, a variety of geographical origins, and a variety of ST and clonal complex types. 9/61 strains did not express Hla, whereas all but one strain expressed Sta006 (data for the 61st strain were inconclusive). Thus a vaccine based on Hla alone is unlikely to give adequate coverage for a universal vaccine, but this problem could be overcome by addition of Sta006.

Cytotoxicity and Cell Binding Studies

The analysis of the potential cellular cytotoxicity by *S. aureus* recombinant antigens Hla, Hla-H35L, IsdA, IsdB, sta006, sta011 and EsxAB was conducted on HBMECs and A549 cells. Annexin V and propidium iodide staining were used to measure the percentage of early and late apoptotic cells by flow cytometry. Endothelial cells were grown in 24 well plates up to fully confluent. Cells were then incubated for 24 hours with three different concentration of recombinant antigens (10 μg/ml, 1 μg/ml, 0.1 μg/ml). The combination of TNF-α and cycloheximide (CHX), which has been reported to induce apoptosis in endothelial cells, was used as a positive control. Incubation with PBS buffer alone was a negative control. Analysis was then performed by FACS.

None of the antigens induced a cytotoxic effect on HBMECs or A549 cells. Indeed, the percentage of live cell population compared to control cells remained essentially constant up to 24 hours of incubation. In contrast, the combination of TNF-α and CHX induced a 25% increase in the number of apoptotic cells.

HBMECs were also used as an in vitro model for testing the binding of *S. aureus* recombinant antigens to human endothelial cells. HBMECs were grown up to confluence at 37° C. in humidified atmosphere in RPMI 1640 medium supplemented with 10% heat-inactivated fetal calf serum, 10% NuSerum, 2 mM glutamine, 1 mM pyruvate, 1% non-essential amino acids, 1% MEM vitamins, 100 units/ml penicillin, and 100 μg/ml streptomycin. Binding of recombinant antigens to the cells was tested by indirect immunofluorescence and analyzed by FACS. The cells positive for binding were measured as net mean intensity of fluorescence respect to negative controls, identified as unspecific antibody recognition. Binding experiments were performed at 4° C. Mouse polyclonal antibodies specific for each of the recombinant antigens were used as primary antibodies and binding was detected by R-Phycoerythrin-conjugated goat anti-mouse IgG secondary antibody. As negative control, HBMECs were incubated with primary polyclonal antibodies detected by fluorescence-labeled secondary antibody or fluorescence-labeled secondary antibody alone. Binding of a known surfaced-exposed GBS antigen was used as positive control.

Hla and Hla-H35L were the only antigens able to strongly bind to endothelial cells. The haemolytic activity of these two antigens was also tested.

De-fibrinated sheep and rabbit blood were used to measure their haemolytic activity by spectrophotometric assay. The blood was incubated at 37° C. for 30 minutes with serial dilution 1:4 of the two proteins. Incubation with water, to cause osmotic lysis, and incubation with a *S.pyogenes* protein, were positive controls; as negative control, the blood was incubated with PBS+BSA 0.5%.

Recombinant native Hla, but not its H35L mutant form, showed haemolytic activity on rabbit erythrocytes. The mutant was at least 150-fold less haemolytic than wild-type. Both proteins had no haemolytic activity on sheep blood.

Thus the *S. aureus* recombinant vaccine candidates do not show any cytotoxicity both on A549 epithelial cell line and HBMEC endothelial cell line. Importantly, Hla, a secreted toxin known to form pores into the plasma membrane of host cells, could bind A549 cells but did not induce cytotoxicity on them; it was also able to induce haemolysis of rabbit erythrocytes. In contrast, recombinant Hla-H35L, a variant toxin with a single amino acid substitution that cannot form cytolytic pores, did not induce cellular damage in both human cell lines and rabbit erythrocytes.

These findings indicate that this mutant form of Hla may be more safely used in a vaccine composition. None of the other antigens showed the capacity to bind to host cells.

Haemolytic Activity of Hla, Hla-PSGS, HlaY101L, and HlaH35L Antigens

The haemolytic activity of the Hla, Hla-PSGS (SEQ ID NO: 216), HlaY101L, and HlaH35L antigens were also tested.

Haemolysis assays were performed using defibrinated blood-derived rabbit erythrocytes, since it has been reported that rabbit red blood cells are more sensitive (Chao and Birkbeck 1978) [303]. Serial dilutions of recombinant vaccine candidates (in PBS+0.5% BSA) were prepared in 96-well plates with U-shaped bottoms. 1 ml of rabbit blood was washed four times in PBS (centrifugation at 3000×g), and red blood cells were resuspended in 5 ml of PBS. An equal volume of red blood cells was added to 50 μl of each toxin dilution and incubated at 37° C. for 30 min. Triton™ 1% (in water) was used to give 100% hemolysis, while PBS+0.5% BSA was used as negative control. Plates were then centrifuged for 5 min at 1000×g, and the supernatant was transferred carefully to 96-well flat-bottomed plates. The percentage of hemolysis was measured analyzing the supernatant at 540 nm absorbance. Wild type Hla was able to induce lysis of erythrocytes in a dose dependent fashion, reaching a plateau of 100% haemolysis (comparable to the effect of water with Triton™ 1%). No lysis was observed after the incubation of red blood cells with HlaH35L or HlaY101L. The Hla-PSGS mutant also does not show any haemolytic activity on rabbit red blood cells (FIG. 17).

Adjuvant Formulation

Selected *S. aureus* protein antigen candidates have been formulated with aluminium hydroxide, either individually or as a combination of proteins, with or without capsular polysaccharide conjugate(s). The formulations have been optimized for pH and osmolarity.

The antigens were EsxA-B, Sta006, Sta011, Hla-H35L, SdrD, IsdA, $IsdA_{40-184}$, Sta019, Sta021, Sta073, $ClfB_{45-552}$, $SdrD_{53-592}$, SasF, and IsdB. These are formulated as monovalent antigens at 100 μg/ml, or as combinations at 50 μg/ml each. Capsular saccharide conjugates from type 5 or type 8 strains are added at 5 μg/ml, 10 μg/ml or 25 μg/ml. Aluminium hydroxide was used at 2 mg/ml, in a 10 mM histidine buffer (pH 6.5) and with 9 mg/ml NaCl.

All monovalent and combination formulations, with or without conjugates, could be adjusted with respect to a desired pH and osmolality. The formulations had pH in the range 6.2-7.3, and osmolality in the range 248-360 mOsm/kg. Glycerol was excluded from formulations as it had a negative impact on osmolality.

All proteins tested, in various monovalent and combination formulations, adsorbed well to the aluminium hydroxide adjuvant, except for IsdA, $IsdA_{40-184}$, Sta019, and Sta073.

The individual Sta006, Sta011, EsxA-B and Hla-H35L proteins were completely adsorbed, and could be desorbed without altering their pre-adsorption electrophoretic profile.

Each antigen in a combination of Sta006, Sta011, EsxA-B and Hla-H35L was completely adsorbed, with no inter-antigen competition for the adjuvant. The antigens in a combination of Sta006, Sta011, EsxA-B and $IsdA_{40-184}$ were also completely adsorbed, except for $IsdA_{40-184}$, which behaved in the same way as the monovalent protein. For both combinations, the antigens could be desorbed without altering their pre-adsorption electrophoretic profile.

The additional presence of type 5 and/or type 8 conjugates also did not change the adsorption or desorption characteristics of the antigens e.g. in combination with Sta006+Sta011+EsxA-B.

A short stability study (2 weeks at 4° C.) was performed to evaluate the stability of monovalent formulations and to evaluate antigen integrity. All tested formulations were stable for their pH and osmolality. All antigens remained completely adsorbed to the adjuvant. All antigens maintained their desorption characteristics. There was no evidence of increased degradation or aggregation of antigens after desorption.

Efficacy Testing

Individual antigens sta006, sta011, sta012, sta017, sta019, sta021 and sta028 were tested for the ability to protect against IV challenge by $1.2\times10^7$ cfu of Newman strain (type 5). Results are shown in FIG. 1. All antigens reduced bacterial numbers compared with the control, and the best results were seen with sta006, sta011 and sta019.

Further individual antigens were tested: (i) NW_10; (ii) $IsdA_{40-184}$; (iii) Sta002; (iv) Sta003; (v) Sta073; (vi) Sta101; (vii) Sta014; (viii) Hla-PSGS; (ix) $SdrD_{CnaB}$. The increase in survival, compared to the negative control group, 15 days after challenge was: (i) 50%; (ii) 19%; (iii) 37%; (iv) 43%; (v) 25%; (vi) 12%; (vii) 25%; (viii) 56%; (ix) 39%.

Two hybrid polypeptides were also tested: (i) HIaH35L-EsxAB; (ii) Sta006-EsxAB. The increase in survival after challenge, compared to the negative control group, was: (i) 25%; (ii) 25%.

Table 2 gives a summary of results obtained with various antigens in the abscess model.

Further experiments tested Hla-PSGS (SEQ ID NO: 216) and HlaH35L antigens in vivo by using sepsis animal model of *S. aureus* infection. In the sepsis model, mice are infected with a lethal dose of *S. aureus* using the intraperitoneal route. The lethal infection model looks at the number of mice which survive after being infected by a normally-lethal dose of *S. aureus* (Compositions for immunizing against *Staphylococcus aureus* (WO/2010/119343)). The size of the inoculum used to get this rate of mortality is $5\times10^8$ for *S. aureus* Newman strain. In these experiments, to further identify the suitability of Hla-PSGS as a candidate for use in vaccines, we investigated whether immunization with Hla-PSGS provides protection in a mouse model of *S. aureus* infection, and whether the results are comparable with HlaH35L mediated protection.

Animal experiments were done with four weeks old CD 1 female mice (Charles River Laboratories) in accordance with the current Italian law and approved by the internal Animal Ethics Committee of Novartis Vaccines and Diagnostics. Mice were immunized with two intraperitoneal doses, two weeks apart, of 20 µg Hla recombinant protein along with Alum as adjuvant. Control mice received an equal amount of PBS along with alum adjuvant. The animal sera were collected on day 0 (Pre-immune) and day 23 for serological studies. Immunized animals were challenged on day 24 by intraperitoneal injection of a lethal dose of *S. aureus*. Mice were monitored daily and euthanized at the appearance of humane endpoints, in agreement with Novartis Animal Welfare Policies.

Figure 16:
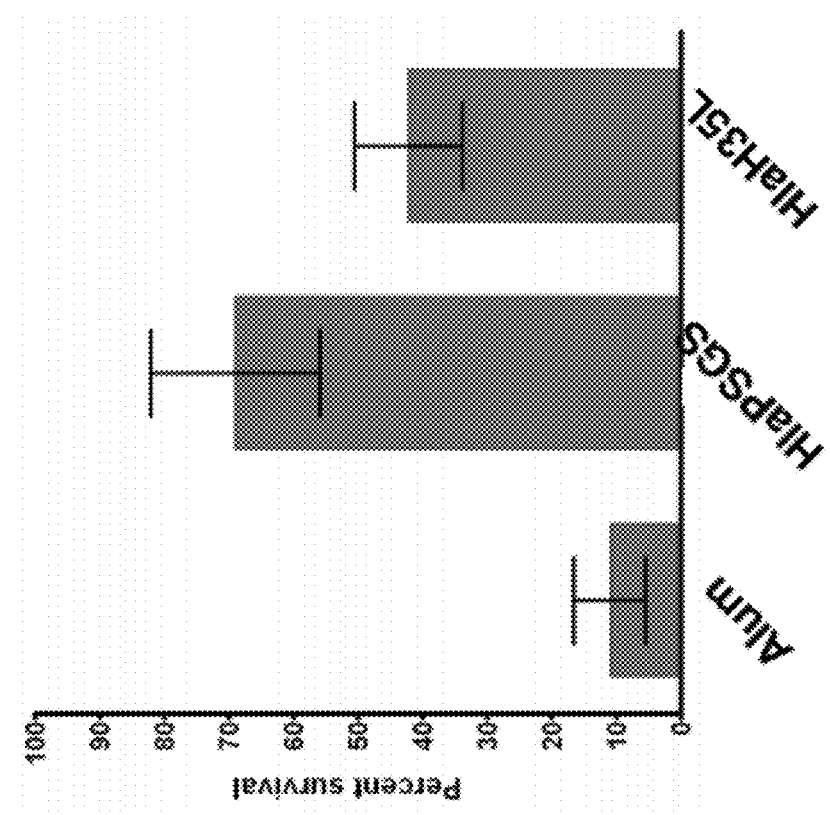
FIG. 16 shows the percentage of mice previously immunised with various compositions (Alum negative control, Hla-PSGS antigen (SEQ ID NO: 216)/alum, and HIaH35L antigen/alum) that survived 14 days after challenge with a lethal does of S. aureus in a sepsis-lethal model study. 64 mice were each immunised with Alum and HIaH35L antigen, and 48 mice were immunised with HIaPSGS. Immunization with HlaH35L or Hla-PSGS protects mice against S. aureus infection. P<0.0001 (statistical significance was calculated with the non-parametric Mann-Whitney test).
Figure 17:
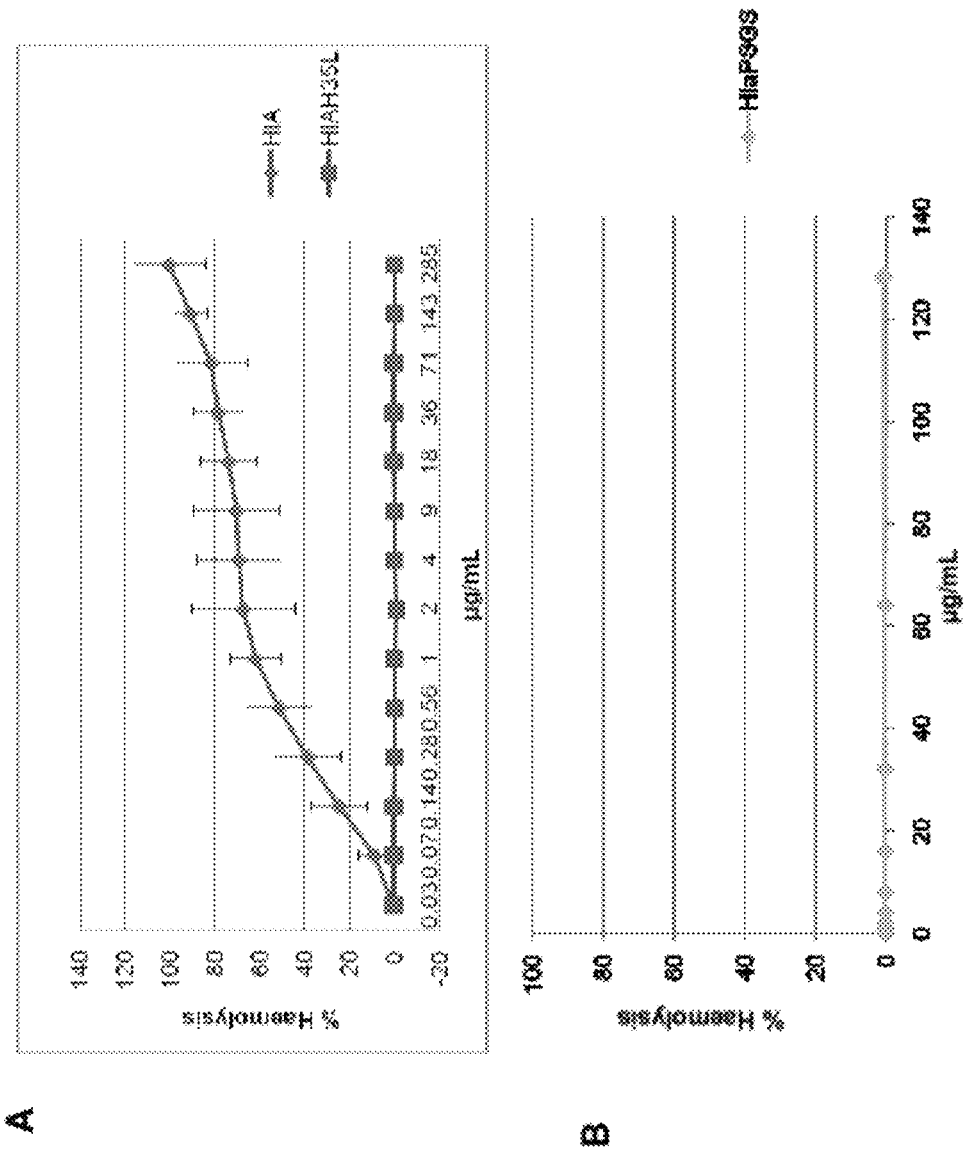
FIG. 17 shows haemolytic activity of various Hla antigens (wild type Hla, HIaH35L, and Hla-PSGS (SEQ ID NO: 216)). Dilutions of Hla antigens were incubated for 30 minutes with defibrinated blood-derived rabbit erythrocytes, and the mixtures were assayed for haemolysis. PBS+BSA 0.5% was used as a negative control, and water+1% Triton X100 was used as a positive control (100% hemolysis).

Both Hla-PSGS and HlaH35L increase mice survival rate compared with the control, and protection obtained with Hla-PSGS is greater than HlaH35L. (FIG. 16)

Figure 2:
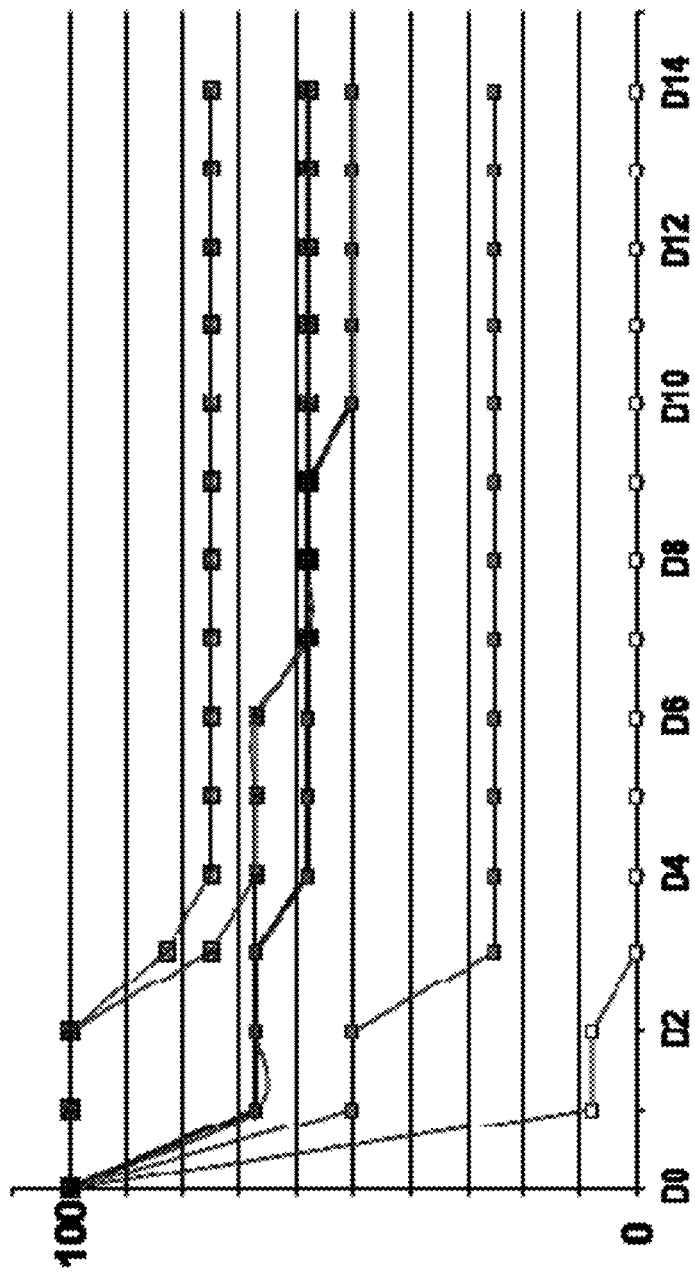
FIGS. 2 to 4 show survival (%) after challenge of mice previously immunised with various mixtures of antigens over 14 days.

Experiment SA-10-a tested the efficacy of antigen combinations. Six groups of twelve CD-1 mice received a negative control (PBS), IsdB, or one of the following combinations, adjuvanted with aluminium hydroxide: (i) EsxAB+Hla-H35L; (ii) Sta006+Sta011+EsxAB; (iii) Sta006+Sta011+EsxAB+Hla-H35L; or (iv) Sta006+Sta011+IsdA$_{40-184}$+EsxAB. Two administrations were given, at days 0 and 14. At day 24 mice received 3×10$^8$ cfu of Newman strain staphylococcus and survival in each group was assessed every 24 hours for two weeks. Results are shown in FIG. 2. After 14 days, 25% of animals in the positive control group had survived, but 50% of animals in group (ii) had survived, as had 58% of animals in groups (iii) & (iv), and 75% in group (i).

Figure 3:
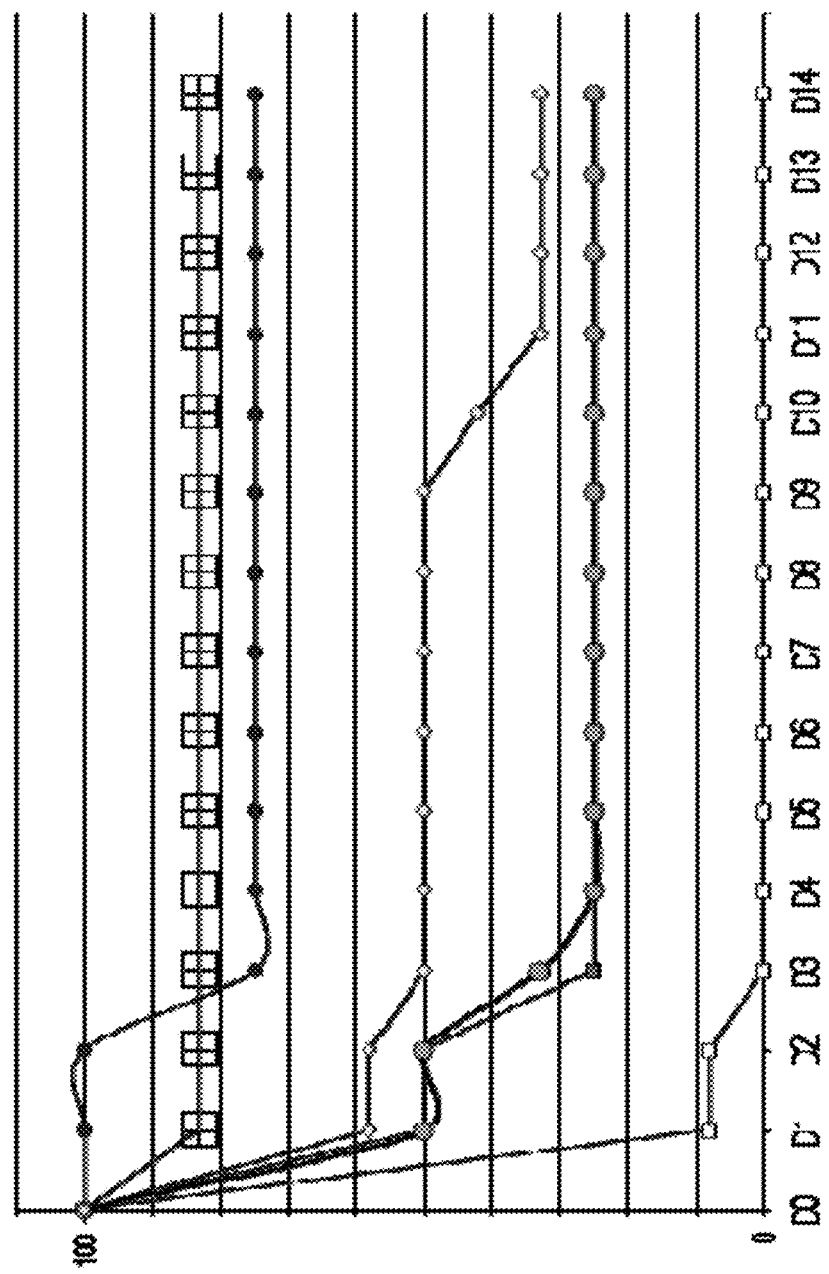

Experiment SA-10-b used the same methods to test: (i) ClfB$_{45-552}$+Hla-H35L+Sta006+EsxAB; (ii) ClfB$_{45-552}$+Sta011+Sta006+EsxAB; (iii) ClfB$_{45-552}$+IsdA$_{40-184}$ Sta006+EsxAB; or (iv) SdrD$_{53-592}$+IsdA$_{40-184}$+Sta006+EsxAB. Results are shown in FIG. 3. After 14 days, 25% of animals in the positive control group and in group (ii) had survived, but 33% of animals in group (iv) had survived, 75% of animals in group (i), and 83% of animals in group (iii).

Further combinations were also used to immunise mice. The combinations were typically adjuvanted with aluminium hydroxide (see above) and were administered on days 0 and 14. The immunisations were in CD1 mice, 12 per group. On day 24 the mice were challenged with a lethal dose of live bacteria and survival was then followed for 14 further days. For comparison, PBS was used as a negative control and IsdB as a positive control [2].

Experiment SA-11 tested: (i) a type 5 conjugate combined with EsxAB+Sta006+Sta011; (ii) EsxAB+Sta019+Sta006+Sta011; (iii) a type 5 conjugate+Hla-H35L+Sta006+Sta011; (iv) EsxAB+Hla-H35L+Sta006+Sta011; or (v) EsxAB+IsdA$_{40-184}$+Sta006+Sta011. 14 days after challenge all of the negative control animals had died, but 42% of positive control animals had survived. Survival results in the test groups were as follows: (i) 67%; (ii) 42%; (iii) 75%; (iv) 33%; and (v) 25%.

Experiment SA-12 tested: (i) Hla-H35L+IsdA$_{40-184}$+Sta006+Sta011; (ii) Hla-H35+EsxAB+Sta006+Sta011; (iii) EsxAB+IsdA$_{40-184}$+Sta006+Sta011; (iv) EsxAB+IsdA+Sta006+Sta011. 14 days after challenge 8% of the negative control animals and 17% of positive control animals had survived. Survival results in the test groups were as follows: (i) 50%; (ii) 50%; (iii) 25%; (iv) 33%.

Figure 4:
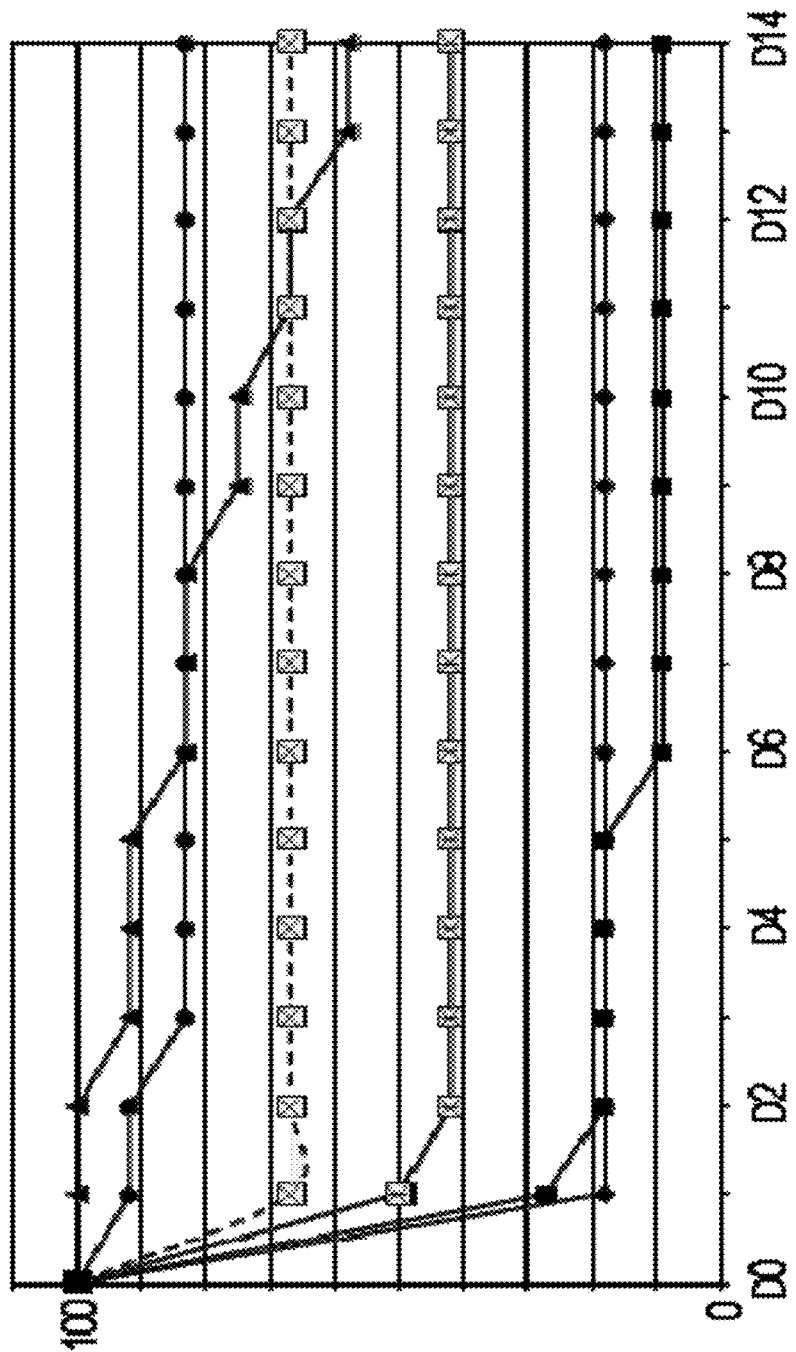

Experiment SA-14 tested: (i) EsxAB+Hla-H35L+Sta006+Sta011; (ii) EsxAB+IsdA$_{40-184}$+Sta006+Sta011; (iii) Sta006+Sta011+Sta019+EsxAB; (iv) Sta006+Sta011+Sta019+Hla-H35L. 14 days after challenge with 5×10$^8$ CFU of Newman strain, 18% of the negative control animals and 9% of positive control animals had survived; survival results in the test groups were as follows: (i) 58%; (ii) 67%; (iii) 42%; (iv) 83%. Survival numbers over 14 days are shown in FIG. 4, showing that all combinations performed better than the two controls on every post-challenge day.

Experiment SA-17a tested: (i) EsxAB+Sta006+Sta011+serotype 5 conjugate+serotype 8 conjugate; (ii) EsxAB+Sta073+Sta011+serotype 5 conjugate+serotype 8 conjugate; (iii) EsxAB+Hla-H35L+Sta011+Sta073. Compared to the negative control, the increase in survival 15 days after challenge with Newman strain was: (i) 17%; (ii) 42%; (iii) 34%. The median survival in groups (ii) and (iii) was the full 15 days, and was 12 days in group (i).

Further antigen combination experiments tested: (a) serotype 5 conjugate+serotype 8 conjugate+EsxAB+Sta006+Sta011; (b) Sta002+Sta003+Sta021+NW-10; (c) EsxAB+HlaH35L+Sta006+Sta019; and (d) EsxAB+Sta006+Sta019. Compared to the negative control, the increase in survival after challenge with Newman strain was: (a) 37%; (b) 36%; (c) 13%.; and (d) 0%.

Figure 5:
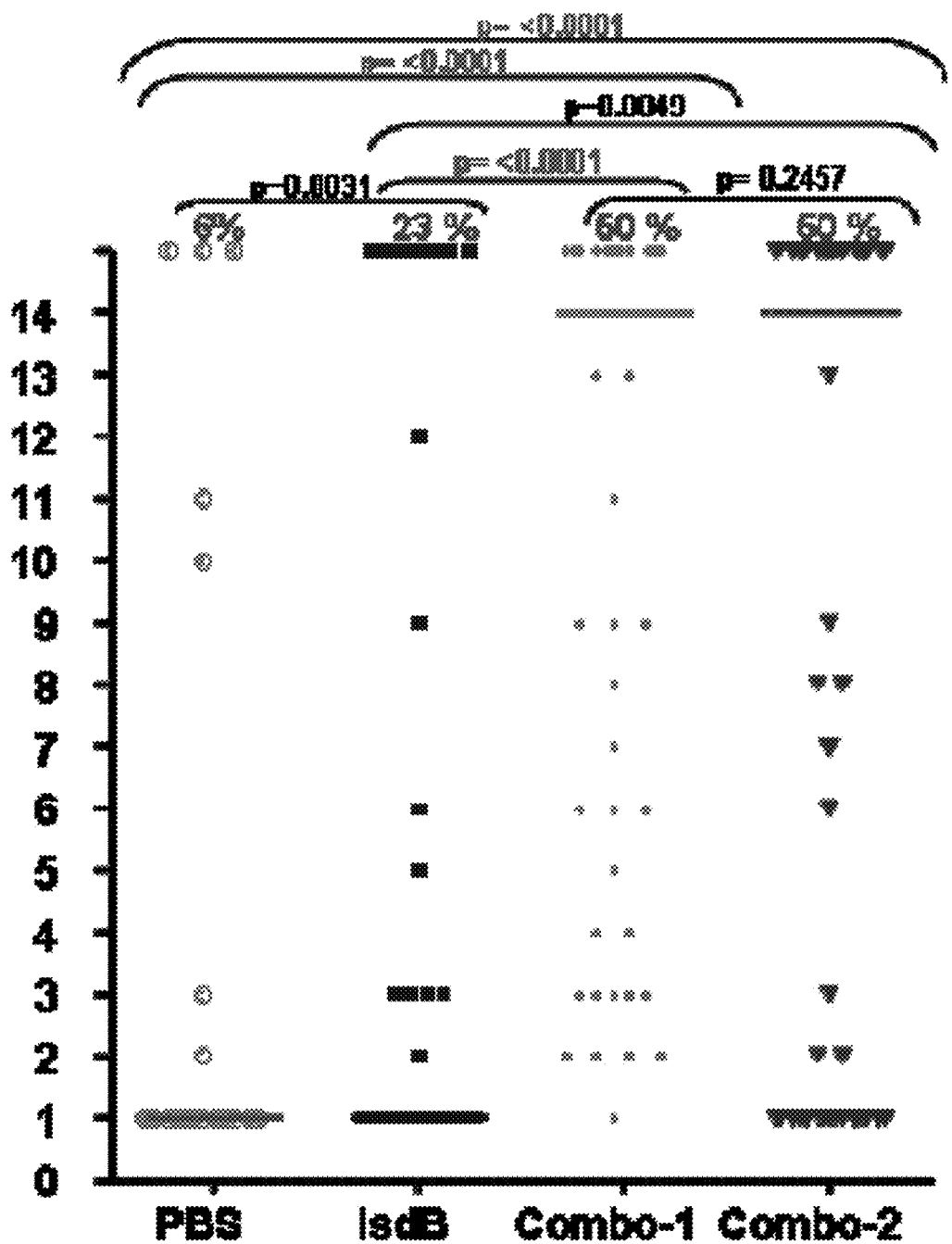
FIG. 5 shows collected data on mouse survival from four different experiments after challenge of mice previously immunised with various compositions (PBS negative control; IsdB antigen; and "Combo-1" and "Combo-2" antigen combinations of the invention). Individual symbols show the survival duration of individual mice; the horizontal bar for each group shows the median survival duration; the percentage figures are survival 14 days after challenge; and the p values at the top are t-Test comparisons of median survival durations between groups.

Survival data from studies SA-10, SA-11, SA-12 and SA-14 were combined to assess the efficacy of two combinations when compared to PBS or IsdB. "Combo-1" was EsxAB+Hla-H35L+Sta006+Sta011 (with polypeptides comprising SEQ ID NOs: 241, 150, 246 & 247). "Combo-2" was EsxAB+IsdA$_{40-184}$+Sta006-Sta011. The median survival times for each group of 48 mice after 14 days were compared. Whereas the PBS and IsdB groups had a median survival time of 1 day, mice in the "Combo-1" and "Combo-2" groups had a median survival time of 14 days. The differences in median survival duration were compared by a t-test: survival in the "Combo-1" group was statistically superior to both the PBS group ($p_<0.0001$) and the IsdB group ($p<0.0001$); survival in the "Combo-2" group was statistically superior to both the PBS group ($p<0.0001$) and the IsdB group ($p=0.0049$). These data are shown in FIG. 5.

Figure 6:
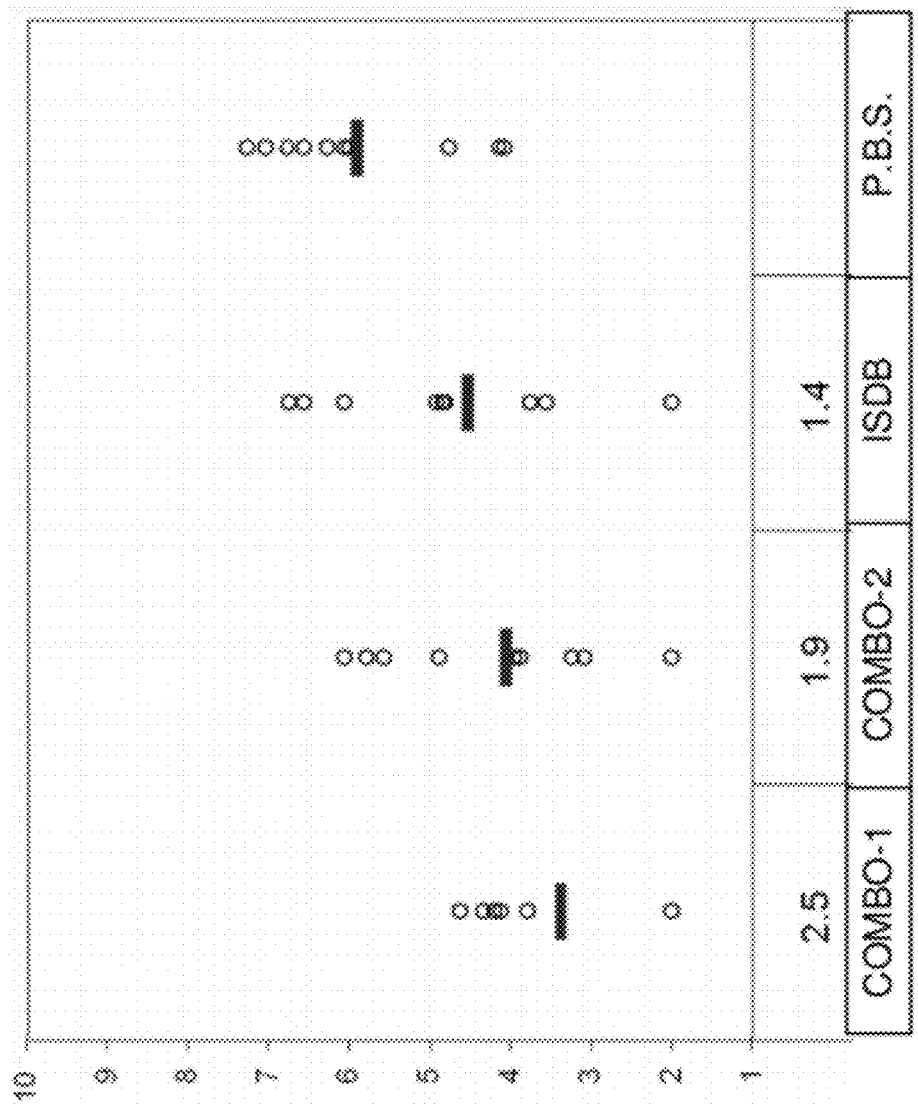
FIG. 6 shows the number of colony forming units (cfu) in mouse kidneys after infection with $9 \times 10^6$ cfu of Newman strain in the abscess model. Horizontal bars are averages per group, and the figure beneath each group is the log reduction relative to the PBS control group.
Figure 8:
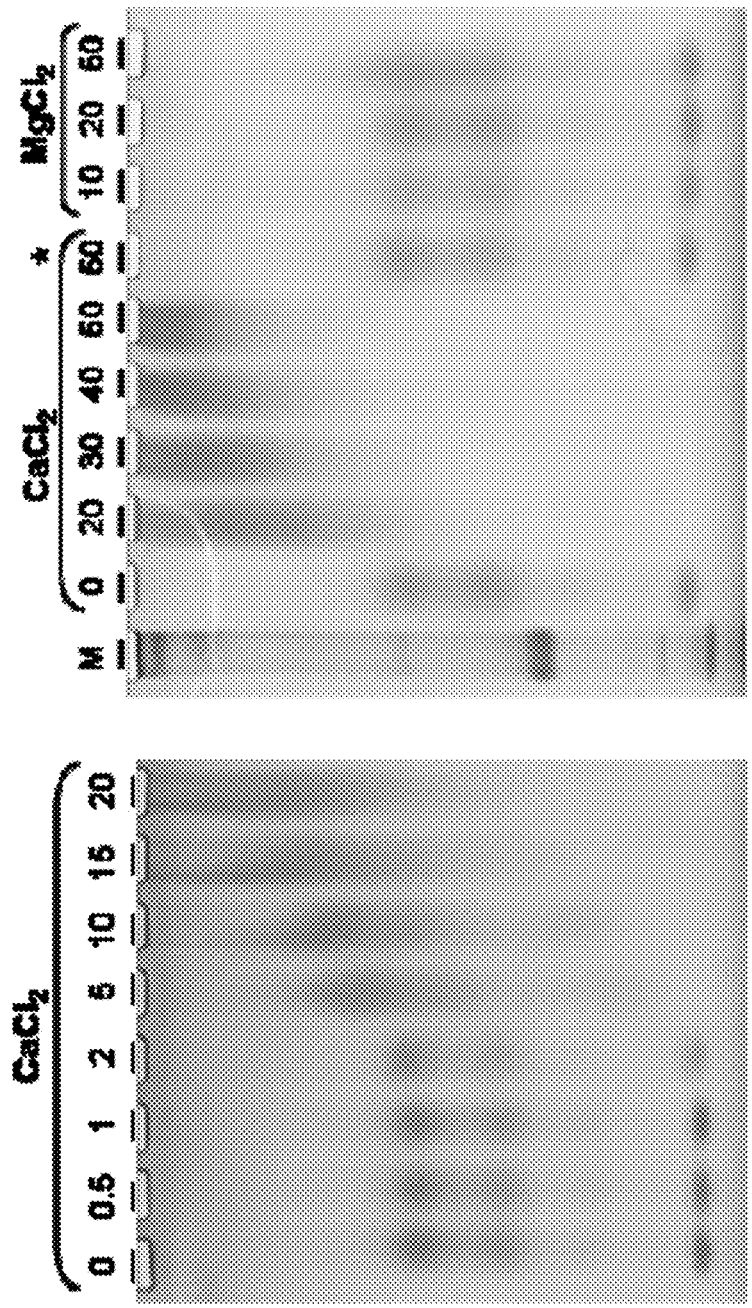
FIG. 8 shows the formation of Sta011 oligomers in the presence of increasing concentrations of $Ca^{++}$ ions. Numbers indicate mM concentrations, and a * indicates the presence of 50 mM EDTA.

FIG. 6 shows data with Combo-1 and Combo-2 in the abscess model. Kidneys of mice are isolated after challenge and are then homogenised and plated. The cfu count indicates the level of abscess formation. FIG. 6 shows data from a single experiment. The numbers beneath the data show the log reduction relative to the PBS group. The reduction is bigger in the two combination groups than with IsdB alone, with U-test (one tail) values of 0.0001 for Combo-1 and 0.0005 for Combo-2. The same effect was seen in the two combination groups in a second experiment in which an IsdB group was not included.

Further experiments compared protection achieved with Combo-1, IsdB or PBS against challenge with three different strains: Staph-19, FPR3757(USA300) and Lac(USA300). There were 44 mice per group and results were as follows (see also FIG. 12), including one-tailed p-values for the survival proportion, where: P1 compares Combo-1 with PBS; P2 compares Combo-1 with IsdB; and P3 compared PBS with IsdB:

|  | Staph-19 | | FPR3757 | | Lac | |
| --- | --- | --- | --- | --- | --- | --- |
| Survival | % | Days | % | Days | % | Days |
| PBS | 20 | 1 | 45 | 8 | 47 | 7 |
| IsdB | 32 | 1 | 52 | 15 | 61 | 15 |
| Combo-1 | 80 | 15 | 91 | 15 | 89 | 15 |
| P1 | <0.0001 | — | <0.0001 | — | 0.0001 | — |
| P2 | <0.0001 | — | <0.0004 | — | 0.0052 | — |
| P3 | 0.1715 | — | 0.2137 | — | 0.1789 | — |

Figure 10:
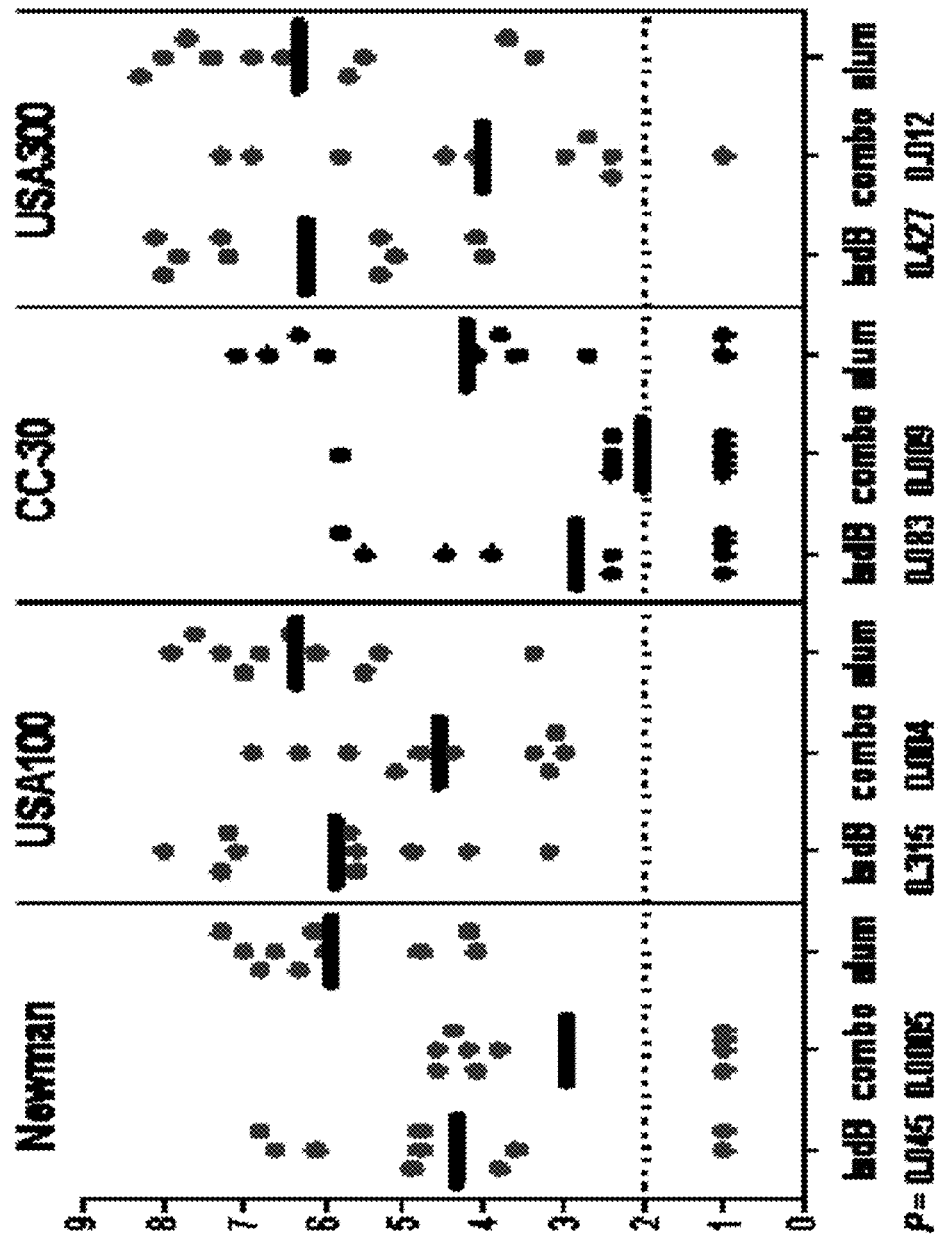
FIG. 10 shows bacterial counts values (log CFU/ml) in mice after challenge with the indicated strains. Each point is an individual animal and the bar shows the median CFU. The P value beneath the IsdB and Combo columns is a comparison against the adjuvant-only control.
Figure 11:
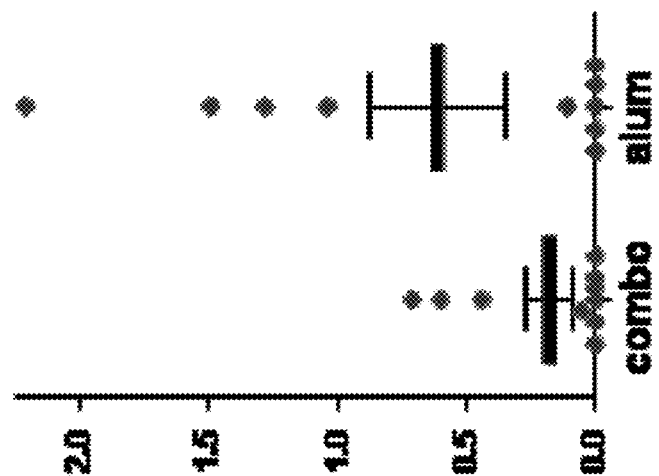
FIG. 11 shows the area of abscesses (mm²) in mice after challenge with Newman strain.

Further experiments showed that immunisation with adjuvanted Combo1 reduced CFU counts after challenge with Newman, USA100, CC30 and USA300 strains, when compared to immunisation with adjuvant alone (aluminium hydroxide) or IsdB. FIG. 10 shows CFU values (log/ml) for the four challenge strains. The lowest count, with p<0.015 in each case, was achieved with Combo1. The area of abscess was also assessed and was also lower in the Combo1-immunised mice (e.g. FIG. 11).

Figure 12:
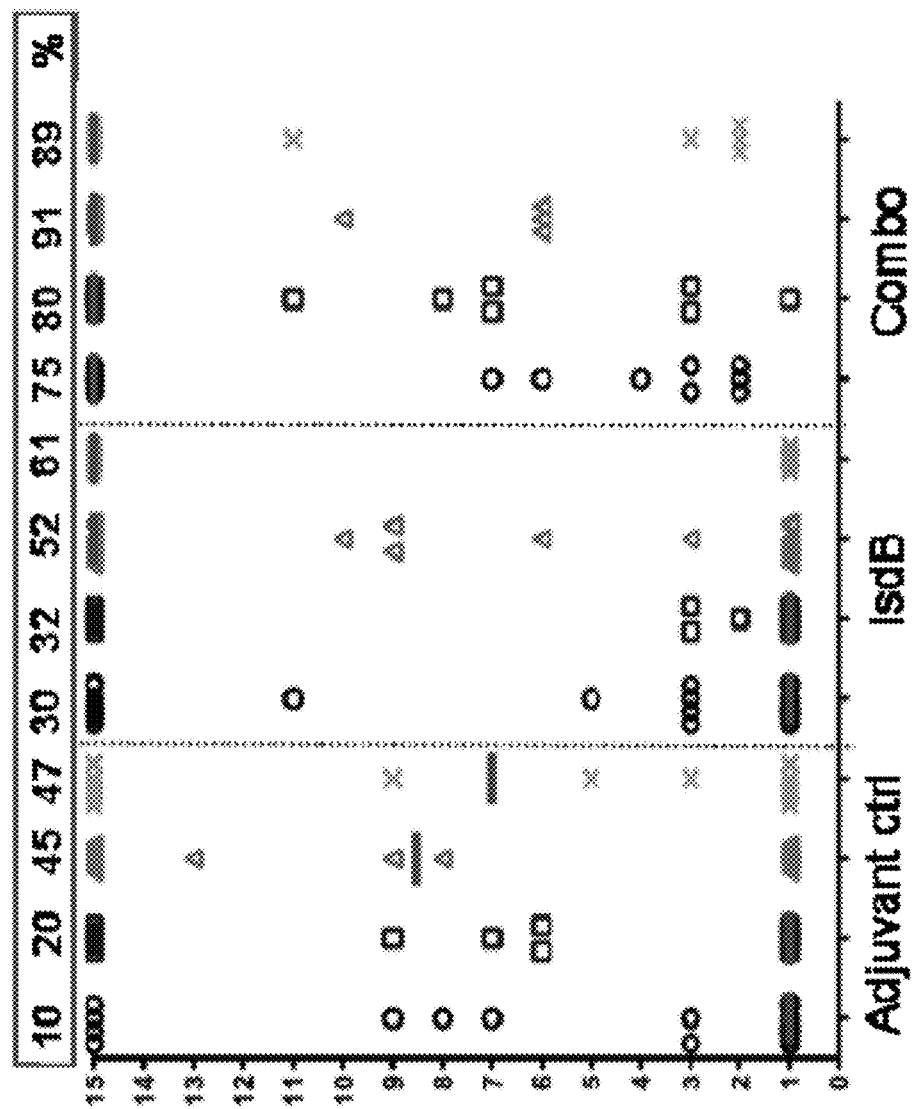
FIG. 12 shows days of survival of mice after challenge with four different strains: Newman (○), ST-80 (□), USA300-FPR3757 (Δ) or USA300-Lac (×) strains. Each point is an individual animal, the bar shows the median survival, and the heading number shows the % of animals surviving after 15 days. Mice received aluminium hydroxide adjuvant alone, IsdB or Combo1.

Further experiments showed that Combo1 is highly protective against clinically relevant strains in the sepsis model, and always achieved a higher survival % than IsdB. FIG. 12 shows that the median survival in Combo1-immunised mice (40 per group, 3 experiments) was the full 15 days when challenged with Newman, ST-80, FPR3757 or Lac strains, and that the proportion of mice surviving was ≥7570. In contrast, the median survival in IsdB-immunised mice was only 1 day with Newman and ST-80 challenge, with <65% survival for all four challenge strains.

Hla

Comparison of Combo1 to Its Individual Polypeptides

Various tests were performed to compare Combo1 to its four individual polypeptides (i.e. EsxAB, Hla-H35L, Sta006, Sta011), as well as to IsdB or to an antigen-free negative control.

The opsonophagocytic activity of sera from immunised animals was tested. Sera were obtained using (i) the four individual polypeptides, (ii) all pairs of the polypeptides, (iii) all triplets, or (iv) the full Combo1 combination. For comparison, anti-IsdB serum was used. Pre-immune and negative control sera showed no killing of Newman strain in this assay. In a first experiment: anti-IsdB serum showed 27% killing; sera against each of the four individual polypeptides showed between 26-34% killing; all multi-polypeptide combinations showed at least 34% killing; and sera raised with Combo-1 showed 39% killing. In a second experiment sera with Combo-1 showed 43% killing but anti-IsdB serum performed slightly better; all single or multi-polypeptide sera using the Combo-1 polypeptides showed at least 26% killing.

Further experiments looked at passive protection achieved by transferring into mice (20 per group, 8 week old CD1 mice) antiserum from immunised rabbits. Four groups received 200 μl of sera from rabbits immunised with one of EsxAB, Hla-H35L, Sta006, Sta011; a fifth group received 50 μl of each serum (200 μl in total). Two other groups received serum from IsdB-immunised rabbits or serum from rabbits immunised with saline+adjuvant. 15 minutes later the mice were challenged intraperitoneally ($10^8$ CFU of Newman strain) and then mortality was assessed after 14 days. Results were as follows:

|  | EsxA-B | Sta006 | Sta011 | HlaH35L | Combo1 | IsdB | -ve ctrl |
| --- | --- | --- | --- | --- | --- | --- | --- |
| Survival | 5% | 26% | 0% | 15% | 25% | 10% | 5% |

In further experiments the level of specific antibodies induced in CD1 mice were examined to assess the immunogenicity of the four polypeptides in Combo1. Compositions included either 20 μg of each of the four single polypeptides, or 4×10 μg in the combination. The compositions included an aluminium hydroxide adjuvant. Serum levels of antigen-specific IgG were determined by Luminex 4Plex assay As shown in FIG. 9, all four polypeptides were highly immunogenic in CD1 mice on their own and in combination. In each case the titer against a polypeptide was higher when it was administered in the combination than when administered alone (compare middle and right pairs).

Further experiments compared protection achieved either with Combo-1 or with its four individual polypeptides. IsdB was also included for comparison. The proportions of animals surviving (40 animals per group) 15 days after challenge with Newman strain, and the average (median) survival in days, were as follows, including a one-tailed p-value of the surviving proportion in comparison with a PBS+adjuvant negative control:

|  | EsxA-B | Sta006 | Sta011 | HlaH35L | Combo1 | IsdB | PBS |
| --- | --- | --- | --- | --- | --- | --- | --- |
| Survival | 34% | 28% | 16% | 39% | 59% | 22% | 5% |
| p | 0.0017 | 0.0003 | 0.0064 | <0.0001 | <0.0001 | 0.0006 | — |
| Days | 1 | 2 | 1 | 10 | 15 | 1 | 0 |

The murine abscess model was used to compare the four individual polypeptides with the Combo1 combination. In some experiments mice were immunised with IsdB for comparison. Antigens were adjuvanted with aluminium hydroxide, and adjuvant alone was used as a negative control. FIG. 7 shows the numbers of bacteria in animals' kidneys after challenge with four different strains. The lowest average counts were seen for the Combo1 combination.

Figure 13:
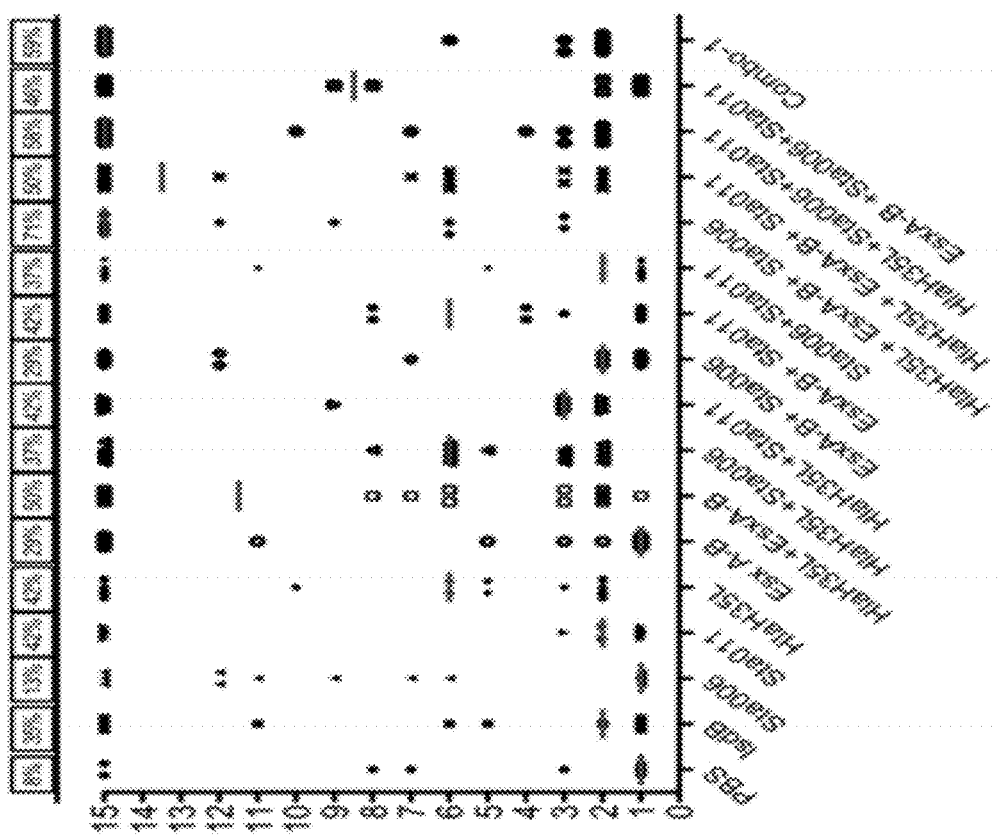
FIG. 13 shows the median survival (days) of mice after challenge. The mice had been immunised with the antigens indicated on the X-axis. Each point is an individual animal and the bar shows the median survival. The heading numbers show the % of animals surviving after 15 days.
Figure 14:
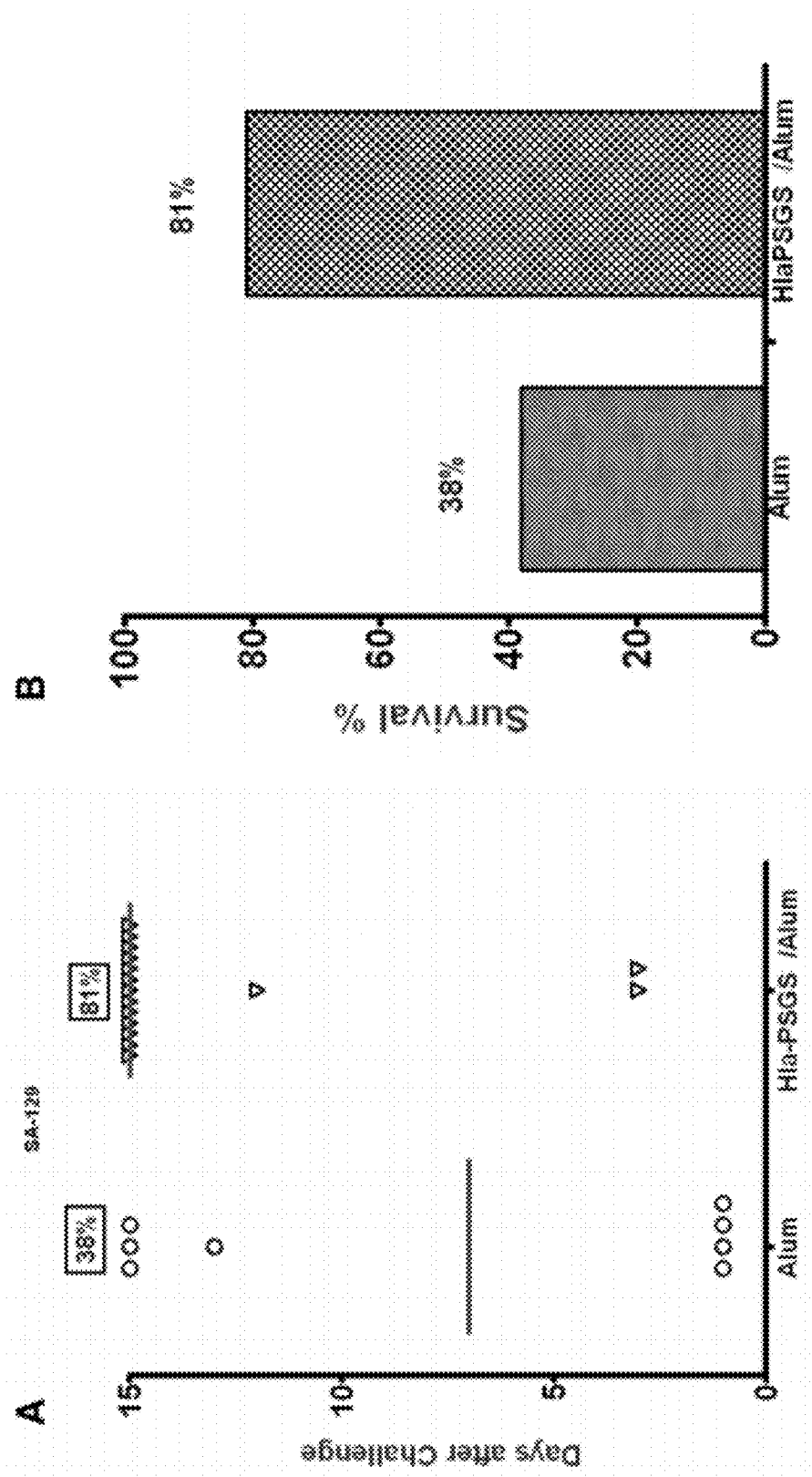
FIG. 14, panel (A) shows days of survival of mice after challenge of mice previously immunised with various compositions (Alum negative control and Hla-PSGS/Alum) with a lethal dose of S. aureus. Individual symbols show the survival duration of individual mice; the horizontal bar for each group shows the median survival duration. Panel (B) shows the percentage of mice that survived 15 days after challenge.
Figure 15:
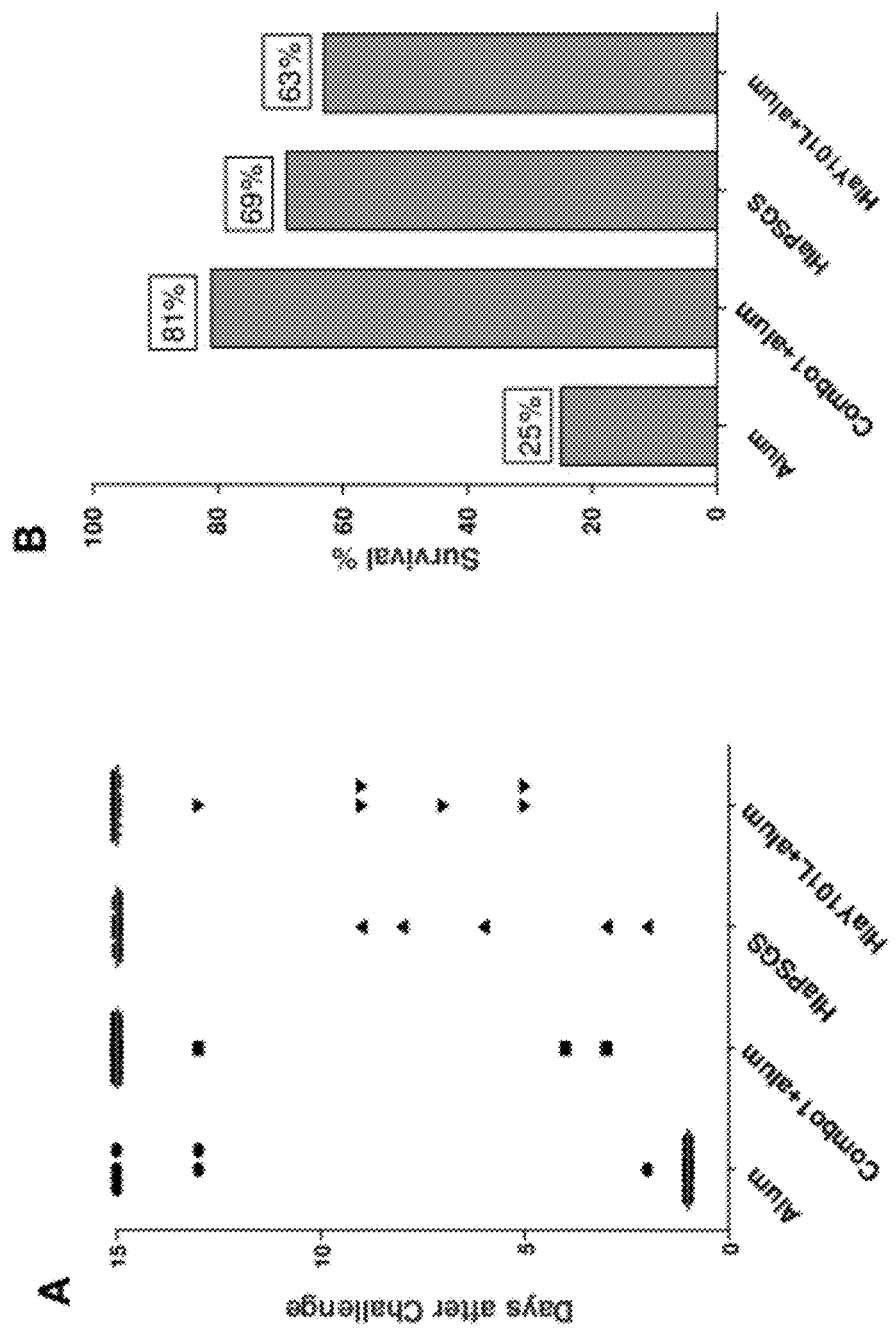
FIG. 15, panel (A) shows days of survival of mice after challenge of mice previously immunised with various compositions (Alum negative control, Combo1/alum, Hla-PSGS antigen (SEQ ID NO: 216)/alum, and HlaY101L/alum) with a lethal dose of S. aureus. Individual symbols show the survival duration of individual mice; the horizontal bar for each group shows the median survival duration. There were 16 mice in each group. Panel (B) shows the percentage of mice that survived 14 days after challenge.

Challenge experiments were performed following immunisation with (i) the four individual polypeptides, (ii) all pairs, (iii) all triplets, or (iv) the full Combo1 combination. IsdB or buffer alone were used for comparison. Survival results from 24 mice per group (3 experiments) after challenge with $5 \times 10^8$ CFU of Newman strain are shown in FIG. 13. The median survival for IsdB was only 2 days. The median survival for the individual Combo1 polypeptides ranged from 1-6 days. Pairs of the polypeptides gave median survival of 2-11 days. Triplets gave median survival of 8-15 days. The full Combo1 combination gave a median survival of the full 15 days, with 59% of mice surviving this long (cf. only 35% with IsdB).

In Silico Design

The Hla gene on the *S. aureus* chromosome encodes the 293 residue protein protomer, which forms heptameric units on the cellular membrane to form a complete beta-barrel pore.

In the effort of engineering a non-toxic *S. aureus* Hla toxin antigen, new constructs were designed in silico: Hla-PSGS (SEQ ID NO: 216) and HlaY101L (SEQ ID NO: 242).

Figure 20:
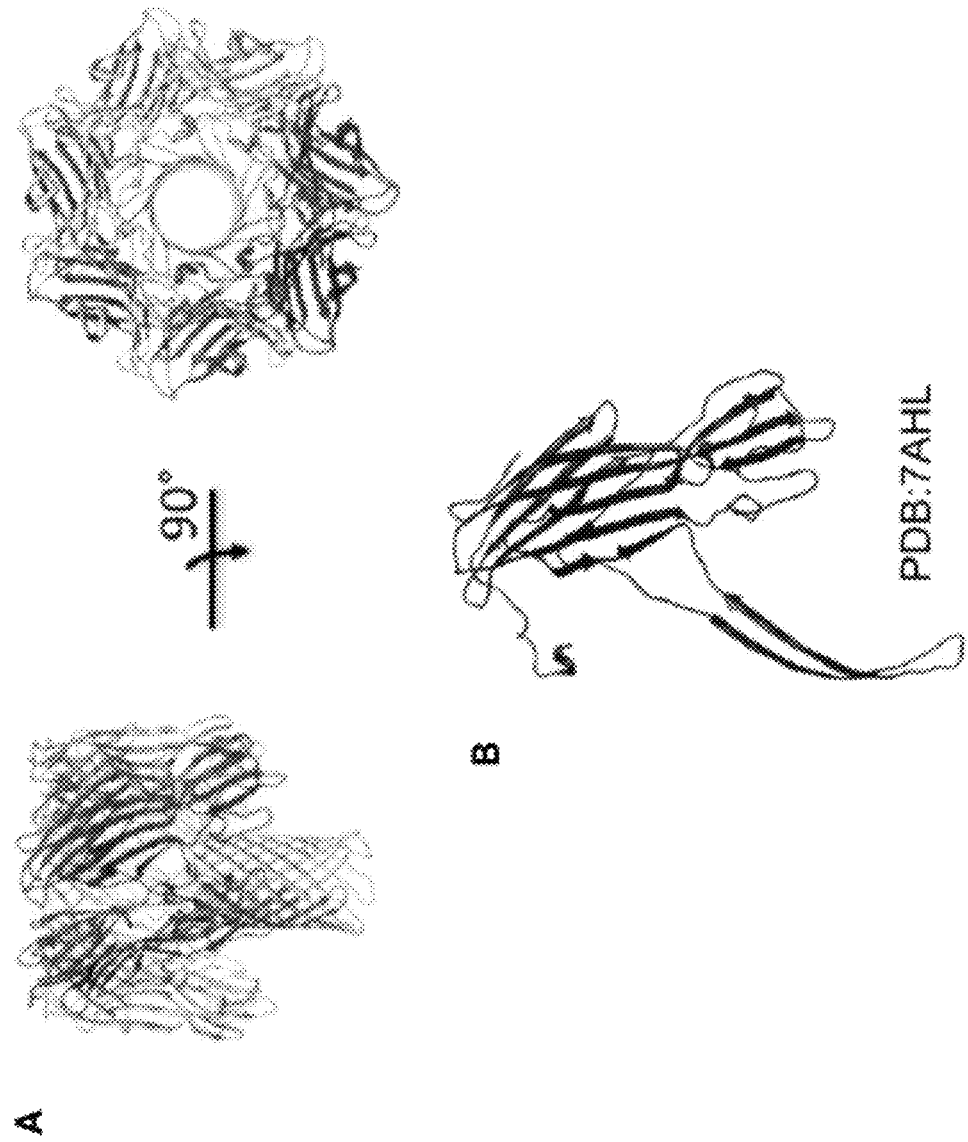
FIG. 20, panel (A) shows two views of the complete heptameric pore structure formed by wild-type Hla polypeptides, modeled from structure PDB: 7AHL. Panel (B) shows the structure of a single wild-type Hla polypeptide, structure PDB: 7AHL.
Figure 21:
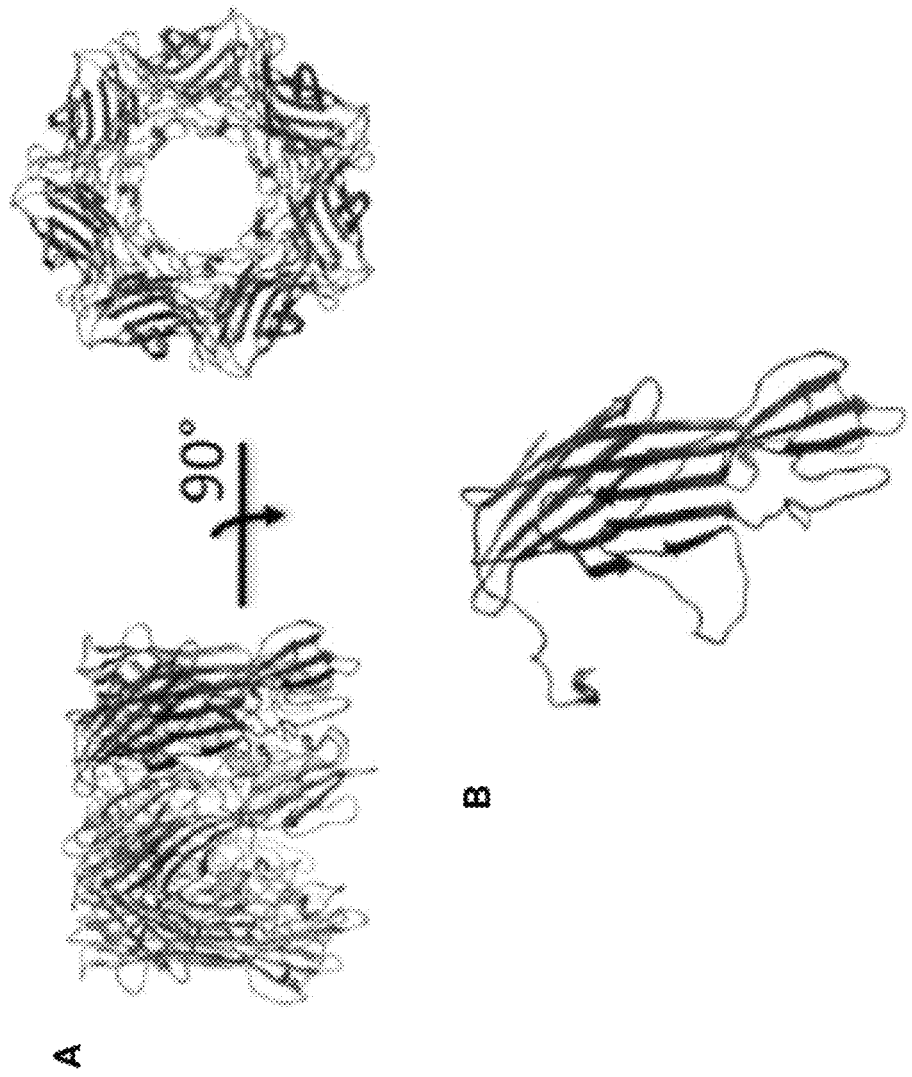
FIG. 21, panel (A) shows two views of the heptameric prepore structure formed by Hla-PSGS polypeptides, modeled from a Hla-PSGS protomer. Panel (B) shows the structure of a single Hla-PSGS protomer.

Hla-PSGS was designed studying the 3D structure of the Hla heptameric pore. The driving concept that led to generation of this mutant relates to the mechanism of action of the single monomer. Any Hla wild type toxin is capable of binding to human cells (Kawate and Gouaux 2003) [312], polymerizing (heptamerizing) and only then forming pore into the cell membrane by protruding a stem like structure inside the cell plasma membrane (FIG. 20). For this reason, a Hla mutant lacking the stem should theoretically being unable to form any cell pore and therefore be non-toxic. Hla-PSGS is an Hla mutant protein whose stem like structure has been replaced by a short amino acid linker (PSGS, Proline-Serine-Glycine-Serine) not sufficiently long to move and protrude inside cell membranes (FIG. 21). The amino acids composing the PSGS linker were carefully chosen taking into account several factors: to avoid steric encumbrance during protein folding and quaternary structure formation of the pore complex, small residues were preferred; to avoid solubility issues, hydrophilic residues were preferred; finally to stabilize and constrain the novel loop in a definite position, the most rigid amino acids such as prolines were preferred.

The Y101L mutation was designed studying the 3D structure of the Hla heptameric pore: in the the Hla heptameric structure, the H35 residue of each Hla monomer binds directly to the Y101 residue of the neighboring Hla monomer through hydrogen bonds. Thus since the H35L mutation is a detoxifying mutation and impairs the ability of establishing any contact with Y101 residue on the neighboring Hla monomer, the Y101 mutation should also impair toxin polymerization, in a similar mechanism to the H35 mutation.

Molecular Modeling

SWISS PDB VIEWER (Guex and Peitsch 1997) [304] version 3.5b was used to generate structural model of alpha-hemolysin PSGS mutant on the basis of the template structure of alpha-hemolysin (Song, Hobaugh et al. 1996)[310](PDB code 7AHL) and for manipulation of torsion angles. The program optimizes the structure of homology models by minimizing a global probability density function that integrates stereochemical parameters and homology-derived restraints. Default parameters were used to satisfy the spatial restraints. The stereochemical validity final model was confirmed using PROCHECK (Laskowski, MacArthur et al. 1993) [305].

All sequence comparisons were performed using databases and computer programs included in the Wisconsin package version 10.0, Genetics Computer Group (GCG), Madison. Secondary structure prediction was carried out with PHD (Rost, Yachdav et al. 2004)[309], available at the PredictProtein web server.

Electron Microscopy

Hla wild type monomer proteins incubated with both human or rabbit erythrocyte ghost membranes originate ring like structures on the membrane surfaces. Such structures are compatible with the expected oligomeric top structure of the complete formed pore: they show an overall ring structure of expected size ~100 Å, smooth circular external edges and an internal pore of expected size ~30 Å (FIG. 22B). The formation of Hla pores could be observed after 5-10 minutes of incubation on ghost membrane at 37° C. Nonetheless, all micrographs were taken after 90 minutes of incubation at 37° C.

HlaH35L monomer proteins incubated with both human or rabbit erythrocyte ghost membranes show no formation of any kind of structure (FIG. 22D).

Hla-PSGS monomer proteins incubated with either human or rabbit erythrocyte ghost membranes show the formation of ring like structures on the membrane surfaces. Such structures are compatible with the expected oligomeric top structure of the wild type complete formed pore (FIG. 22C).

Hla-PSGS was able to form a complete prepore structure in absence of erythrocyte ghost membranes (FIG. 22F), while Hla wild type is known to be unable to form quaternary structure in absence of a supporting membrane (FIG. 22E).

To prepare samples for electron microscopy, the following procedure was followed: A 5 µl aliquot of purified protein preparation with a final concentration of 0.05 µg/µl was applied to 300-square mesh copper or nickel grids coated with a thin carbon film and let stand for 5 min. Excess of solution was blotted by Whatman filter paper. The grids were first washed by streaming several drops of PBS over the grids, they were subsequently negatively stained by two drops of 1% buffered uranyl acetate (AcU) pH 4.5 or 1% buffered ammonium molybdate (AMb) pH 7. The last drop was left on the grids for 20 s (AcU) or 40 s (AMb). Finally the grids were washed with several drops of $ddH_2O$, the excess of liquid was soaked off by Whatman filter paper and air-dried. The grids were observed using a TEM FEI Tecnai G2 spirit operating at 80 kV equipped with a CCD camera Olympus SIS Morada.

Protocols for preparing ghost membranes are described in Burton et al. [313].

Image Processing

Analysis of defocus and Contrast Transfer Function (CTF) were performed using the Medical Research Council (MRC) program CTFFIND3 (Mindell and Grigorieff 2003)[307] and IMAGIC 5 (van Heel, Harauz et al. 1996)[311]. Single particles were picked semi-automatically from digitized images using the Boxer tool from the EMAN software package (Ludtke, Baldwin et al. 1999)[306]. Images were cut into individual boxes of 128×128 pixels. Images were band-pass filtered to remove background and normalized using IMAGIC 5 (van Heel, Harauz et al. 1996)[311]. Boxed particles were collected than classified by MSA to sort images into class averages with similar features. Euler angles were assigned to class averages that were used to reconstruct an initial 3-D map.

The 3-D map was than refined by adding class averages of the side views along as reprojections from initial 3-D map. Image processing was performed using software IMAGIC-5 (van Heel, Harauz et al. 1996)[311]. The final 3-D map was refined at 30 Å resolution (FSC=0.5) according to EMAN or at 28 Å resolution (FSC ½ bit) according to IMAGIC 5. 3D rendered surface representations were visualized in UCSF Chimera (Pettersen, Goddard et al. 2004)[308].

Single Particle Reconstruction

Though the X-ray crystal structure of Hla complete pore has been determined, it was not referenced in any way during any part of the reconstruction procedure.

The reconstruction was performed using ~10000 particles taken from 40 micrographs of Hla-PSGS in absence of ghost membrane substrate at 80 keV. Approximately 5000 particles were discarded in the final reconstructed model. The elimination process was performed manually during the reconstruction by comparing each particle to others in approximately the same orientation, and keeping only the most self-consistent data.

Figure 23:
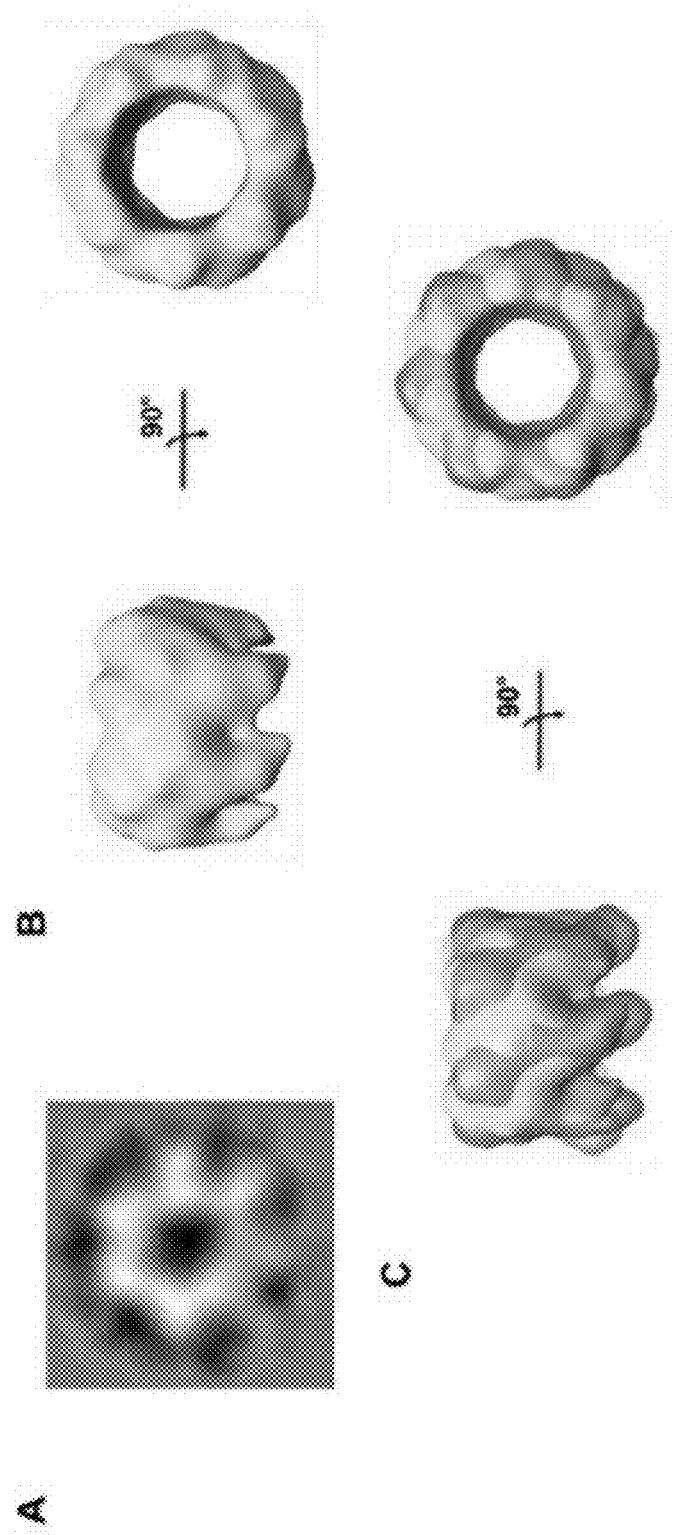
FIG. 23 shows Single Particle Reconstruction of Hla-PSGS. Panel (A): Hla-PSGS class average obtained from TEM images; Panel (B): Hla-PSGS reconstructed at 28 Å resolution, side and top views; Panel (C): comparison of three-dimensional structure of Hla-PSGS from Single Particle Reconstruction (light gray) and the Hla-PSGS structure designed in silico (dark gray), both obtained at 28 Å resolution.

During the class average selection, the heptameric conformation of the Hla-PSGS was already clear (FIG. 23A). The final 3D model, obtained after 2 rounds of iterative refinement is shown in FIG. 23B. In order to validate our structure, we compared our reconstruction with the X-ray crystallographic derived Hla-PSGS model, which was transformed in density map using em2em (EMANI) with 20 Å resolution parameter. Density map superimposition showed a neat correlation of shapes and overall sizes: both structures portray a donut shape, 7-fold symmetry (C7), ~100 Å diameter, ~70 Å height with ~35 Å internal pore diameter (FIG. 23C).

It will be understood that the invention has been described by way of example only and modifications may be made whilst remaining within the scope and spirit of the invention.

TABLE 1

NOMENCLATURE CROSS-REFERENCE; *Staphylococcus aureus* vaccine candidates, in silico selection.

| SEQ ID NO | Name | NCTC 8325 strain SAOUHSC_# | GI | Newman strain NMWN_# | GI |
|---|---|---|---|---|---|
| 1 | clfA | SAOUHSC_00812 | 88194572 | NWMN_0756 | 151220968 |
| 2 | clfB | SAOUHSC_02963 | 88196585 | NWMN_2529 | 151222741 |
| 3 | coA | SAOUHSC_00192 | 88194002 | NWMN_0166 | 151220378 |
| 4 | eap | SAOUHSC_02161 | 88195840 | NWMN_1872 | 151222084 |
| 5 | ebhA | SAOUHSC_01447 | 88195168 | — | — |
| 6 | ebpS | SAOUHSC_01501 | 88195217 | NWMN_1389 | 151221601 |
| 7 | efb | SAOUHSC_01114 | 88194860 | NWMN_1069 | 151221281 |
| 8 | emp | SAOUHSC_00816 | 88194575 | NWMN_0758 | 151220970 |
| 9 | esaC | SAOUHSC_00264 | 88194069 | — | — |
| 10 | esxA | SAOUHSC_00257 | 88194063 | — | — |
| 11 | esxB | SAOUHSC_00265 | 88194070 | — | — |
| 12 | FnBA | SAOUHSC_02803 | 88196438 | NWMN_2399 | 151222611 |
| 13 | FnBB | SAOUHSC_02802 | 88196437 | NWMN_2397 | 151222609 |
| 14 | hla | SAOUHSC_01121 | 88194865 | NWMN_1073 | 151221285 |
| 15 | hlgB | SAOUHSC_02710 | 88196350 | — | — |
| 16 | hlgC | SAOUHSC_02709 | 88196349 | — | — |
| 17 | isdA | SAOUHSC_01081 | 88194829 | NWMN_1041 | 151221253 |
| 18 | isdB | SAOUHSC_01079 | 88194828 | — | — |
| 19 | isdC | SAOUHSC_01082 | 88194830 | — | — |
| 20 | isdG | SAOUHSC_01089 | 88194836 | — | — |
| 21 | isdH | SAOUHSC_01843 | 88195542 | NWMN_1624 | 151221836 |
| 22 | isdI | SAOUHSC_00130 | 88193943 | — | — |
| 23 | lukD | SAOUHSC_01954 | 88195647 | NWMN_1718 | 151221930 |
| 24 | lukE | SAOUHSC_01955 | 88195648 | — | — |
| 25 | lukF | SAOUHSC_02241 | 88195914 | — | — |
| 26 | lukS | SAOUHSC_02243 | 88195915 | NWMN_1928 | 151222140 |
| 27 | nuc | SAOUHSC_01316 | 88195046 | — | — |
| 28 | sasA | SAOUHSC_02990 | 88196609 | — | — |
| 29 | sasB | SAOUHSC_02404 | 88196065 | — | — |
| 30 | sasC | SAOUHSC_01873 | 88195570 | — | — |
| 31 | sasD | SAOUHSC_00094 | 88193909 | — | — |
| 32 | sasF | SAOUHSC_02982 | 88196601 | — | — |
| 33 | sdrC | SAOUHSC_00544 | 88194324 | — | — |
| 34 | sdrD | SAOUHSC_00545 | 88194325 | — | — |
| 35 | sdrE2 | — | — | NWMN_0525 | 151220737 |
| 36 | spa | SAOUHSC_00069 | 88193885 | NWMN_0055 | 151220267 |
| 37 | sta001 | SAOUHSC_00025 | 88193846 | NWMN_0022 | 151220234 |
| 38 | sta002 | SAOUHSC_00356 | 88194155 | NWMN_0364 | 151220576 |
| 39 | sta003 | SAOUHSC_00400 | 88194195 | NWMN_0401 | 151220613 |
| 40 | sta004 | SAOUHSC_00749 | 88194514 | NWMN_0705 | 151220917 |
| 41 | sta005 | SAOUHSC_01127 | 88194870 | NWMN_1077 | 151221289 |
| 42 | sta006 | SAOUHSC_02554 | 88196199 | NWMN_2185 | 151222397 |
| 43 | sta007 | SAOUHSC_02571 | 88196215 | NWMN_2199 | 151222411 |
| 44 | sta008 | SAOUHSC_02650 | 88196290 | NWMN_2270 | 151222482 |
| 45 | sta009 | SAOUHSC_02706 | 88196346 | NWMN_2317 | 151222529 |
| 46 | sta010 | SAOUHSC_02887 | 88196515 | NWMN_2469 | 151222681 |
| 47 | sta011 | SAOUHSC_00052 | 88193872 | — | — |
| 48 | sta012 | SAOUHSC_00106 | 88193919 | — | — |
| 49 | sta013 | SAOUHSC_00107 | 88193920 | — | — |
| 50 | sta014 | SAOUHSC_00137 | 88193950 | — | — |
| 51 | sta015 | SAOUHSC_00170 | 88193980 | — | — |
| 52 | sta016 | SAOUHSC_00171 | 88193981 | — | — |
| 53 | sta017 | SAOUHSC_00186 | 88193996 | — | — |
| 54 | sta018 | SAOUHSC_00201 | 88194011 | — | — |
| 55 | sta019 | SAOUHSC_00248 | 88194055 | NWMN_0210 | 151220422 |
| 56 | sta020 | SAOUHSC_00253 | 88194059 | — | — |
| 57 | sta021 | SAOUHSC_00256 | 88194062 | — | — |
| 58 | sta022 | SAOUHSC_00279 | 88194083 | — | — |
| 59 | sta023 | SAOUHSC_00284 | 88194087 | — | — |
| 60 | sta024 | SAOUHSC_00300 | 88194101 | — | — |
| 61 | sta025 | SAOUHSC_00362 | 88194160 | — | — |
| 62 | sta026 | SAOUHSC_00404 | 88194198 | — | — |
| 63 | sta027 | SAOUHSC_00661 | 88194426 | — | — |
| 64 | sta028 | SAOUHSC_00671 | 88194436 | NWMN_0634 | 151220846 |
| 65 | sta029 | SAOUHSC_00754 | 88194518 | — | — |
| 66 | sta030 | SAOUHSC_00808 | 88194568 | — | — |
| 67 | sta031 | SAOUHSC_00860 | 88194617 | — | — |
| 68 | sta032 | SAOUHSC_00958 | 88194715 | — | — |
| 69 | sta033 | SAOUHSC_00987 | 88194744 | — | — |
| 70 | sta034 | SAOUHSC_00988 | 88194745 | — | — |
| 71 | sta035 | SAOUHSC_00998 | 88194754 | — | — |
| 72 | sta036 | SAOUHSC_01084 | 88194831 | — | — |
| 73 | sta037 | SAOUHSC_01085 | 88194832 | — | — |

TABLE 1-continued

NOMENCLATURE CROSS-REFERENCE; *Staphylococcus aureus* vaccine candidates, in silico selection.

| SEQ ID NO | Name | NCTC 8325 strain SAOUHSC_# | GI | Newman strain NMWN_# | GI |
|---|---|---|---|---|---|
| 74 | sta038 | SAOUHSC_01088 | 88194835 | — | — |
| 75 | sta039 | SAOUHSC_01124 | 88194868 | — | — |
| 76 | sta040 | SAOUHSC_01125 | 88194869 | NWMN_1076 | 151221288 |
| 77 | sta041 | SAOUHSC_01175 | 88194914 | — | — |
| 78 | sta042 | SAOUHSC_01180 | 88194919 | — | — |
| 79 | sta043 | SAOUHSC_01219 | 88194955 | — | — |
| 80 | sta044 | SAOUHSC_01508 | 88195223 | — | — |
| 81 | sta045 | SAOUHSC_01627 | 88195337 | — | — |
| 82 | sta046 | SAOUHSC_01918 | 88195613 | — | — |
| 83 | sta047 | SAOUHSC_01920 | 88195615 | — | — |
| 84 | sta048 | SAOUHSC_01949 | 88195642 | — | — |
| 85 | sta049 | SAOUHSC_01972 | 88195663 | NWMN_1733 | 151221945 |
| 86 | sta050 | SAOUHSC_02127 | 88195808 | — | — |
| 87 | sta051 | SAOUHSC_02147 | 88195827 | — | — |
| 88 | sta052 | SAOUHSC_02246 | 88195918 | — | — |
| 89 | sta053 | SAOUHSC_02257 | 88195928 | — | — |
| 90 | sta054 | SAOUHSC_02333 | 88195999 | — | — |
| 91 | sta055 | SAOUHSC_02448 | 88196100 | — | — |
| 92 | sta056 | SAOUHSC_02463 | 88196115 | — | — |
| 93 | sta057 | SAOUHSC_02576 | 88196220 | NWMN_2203 | 151222415 |
| 94 | sta058 | SAOUHSC_02690 | 88196330 | — | — |
| 95 | sta059 | SAOUHSC_02708 | 88196348 | — | — |
| 96 | sta060 | SAOUHSC_02767 | 88196403 | — | — |
| 97 | sta061 | SAOUHSC_02783 | 88196419 | — | — |
| 98 | sta062 | SAOUHSC_02788 | 88196424 | — | — |
| 99 | sta063 | SAOUHSC_02971 | 88196592 | — | — |
| 100 | sta064 | SAOUHSC_03006 | 88196625 | NWMN_2569 | 151222781 |
| 101 | sta065 | SAOUHSC_00051 | 88193871 | — | — |
| 102 | sta066 | SAOUHSC_00172 | 88193982 | — | — |
| 103 | sta067 | SAOUHSC_00176 | 88193986 | — | — |
| 104 | sta068 | SAOUHSC_00327 | 88194127 | — | — |
| 105 | sta069 | SAOUHSC_00427 | 88194219 | — | — |
| 106 | sta070 | SAOUHSC_00773 | 88194535 | — | — |
| 107 | sta071 | SAOUHSC_00854 | 88194612 | — | — |
| 108 | sta072 | SAOUHSC_00872 | 88194629 | — | — |
| 109 | sta073 | SAOUHSC_00994 | 88194750 | NWMN_0922 | 151221134 |
| 110 | sta074 | SAOUHSC_01220 | 88194956 | — | — |
| 111 | sta075 | SAOUHSC_01256 | 88194989 | — | — |
| 112 | sta076 | SAOUHSC_01263 | 88194996 | — | — |
| 113 | sta077 | SAOUHSC_01317 | 88195047 | — | — |
| 114 | sta078 | SAOUHSC_01857 | 88195555 | — | — |
| 115 | sta079 | SAOUHSC_01935 | 88195630 | — | — |
| 116 | sta080 | SAOUHSC_01936 | 88195631 | — | — |
| 170 | sta081 | SAOUHSC_01938 | 88195633 | | |
| 117 | sta082 | SAOUHSC_01939 | 88195634 | — | — |
| 118 | sta083 | SAOUHSC_01941 | 88195635 | — | — |
| 119 | sta084 | SAOUHSC_01942 | 88195636 | — | — |
| 120 | sta085 | SAOUHSC_02171 | 88195848 | — | — |
| 121 | sta086 | SAOUHSC_02327 | 88195993 | — | — |
| 122 | sta087 | SAOUHSC_02635 | 88196276 | — | — |
| 123 | sta088 | SAOUHSC_02844 | 88196477 | — | — |
| 124 | sta089 | SAOUHSC_02855 | 88196486 | — | — |
| 125 | sta090 | SAOUHSC_02883 | 88196512 | — | — |
| 126 | sta091 | SAOUHSC_00685 | 88194450 | — | — |
| 127 | sta092 | SAOUHSC_00174 | 88193984 | — | — |
| 128 | sta093 | SAOUHSC_01854 | 88195552 | — | — |
| 129 | sta094 | SAOUHSC_01512 | 88195226 | — | — |
| 130 | sta095 | SAOUHSC_00383 | 88194180 | NWMN_0388 | 151220600 |
| 131 | sta096 | SAOUHSC_00384 | 88194181 | — | — |
| 132 | sta097 | SAOUHSC_00386 | 88194182 | — | — |
| 133 | sta098 | SAOUHSC_00389 | 88194184 | NWMN_0391 | 151220603 |
| 134 | sta099 | SAOUHSC_00390 | 88194185 | — | — |
| 135 | sta100 | SAOUHSC_00391 | 88194186 | — | — |
| 136 | sta101 | SAOUHSC_00392 | 88194187 | NWMN_0394 | 151220606 |
| 137 | sta102 | SAOUHSC_00393 | 88194188 | — | — |
| 138 | sta103 | SAOUHSC_00394 | 88194189 | — | — |
| 139 | sta104 | SAOUHSC_00395 | 88194190 | — | — |
| 140 | sta105 | SAOUHSC_00399 | 88194194 | NWMN_0400 | 151220612 |
| 141 | sta106 | SAOUHSC_01115 | 88194861 | — | — |
| 177 | sta107 | SAOUHSC_00354 | 88194153 | NWMN_0362 | 151220574 |
| 178 | sta108 | SAOUHSC_00717 | 88194482 | NWMN_0677 | 151220889 |
| 179 | sta109 | SAOUHSC_02979 | 88196599 | NWMN_2543 | 151222755 |
| 180 | sta110 | SAOUHSC_01039 | 88194791 | | |

TABLE 1-continued

NOMENCLATURE CROSS-REFERENCE; *Staphylococcus aureus* vaccine candidates, in silico selection.

| SEQ ID NO | Name | NCTC 8325 strain SAOUHSC_# | GI | Newman strain NMWN_# | GI |
|---|---|---|---|---|---|
| 181 | sta111 | SAOUHSC_01005 | 88194760 | NMWN_0931 | 151221143 |
| 182 | sta112 | SAOUHSC_00634 | 88194402 | NMWN_0601 | 151220813 |
| 183 | sta113 | SAOUHSC_00728 | 88194493 | NMWN_0687 | 151220899 |
| 184 | sta114 | SAOUHSC_00810 | 88194570 | | |
| 185 | sta115 | SAOUHSC_00817 | 88194576 | NMWN_0759 | 151220971 |
| 186 | sta116 | SAOUHSC_01112 | 88194858 | NMWN_1067 | 151221279 |
| 187 | sta117 | SAOUHSC_02240 | 88195913 | NMWN_1926 | 151222138 |
| 188 | sta118 | SAOUHSC_01150 | 88194892 | NMWN_1096 | 151221308 |
| 200 | sta119 | SAOUHSC_01100 | 88194846 | | |
| 201 | sta120 | SAOUHSC_00365 | 88194163 | | |
| 142 | NW_6 | — | — | NMWN_0757 | 151220969 |
| 143 | NW_9 | — | — | NMWN_0958 | 151221170 |
| 144 | NW_10 | — | — | NMWN_1066 | 151221278 |
| 145 | NW_7 | — | — | NMWN_1876 | 151222088 |
| 146 | NW_8 | — | — | NMWN_1877 | 151222089 |
| 147 | NW_2 | — | — | NMWN_1883 | 151222095 |
| 148 | NW_1 | — | — | NMWN_1924 | 151222136 |
| 149 | NW_5 | — | — | NMWN_2392 | 151222604 |

TABLE 2

ABSCESS MODEL RESULTS SUMMARY

| Immunising antigen(s) | Adjuvant | infecting strain & dose | | Reduction** |
|---|---|---|---|---|
| Fnb | alum* | Newman | 1.4E+07 | 2.13 |
| Sta005 | alum | Newman | 1.4E+07 | 1.26 |
| LukE | alum | Newman | 1.4E+07 | 1.68 |
| SasD | alum | Newman | 1.4E+07 | 0.10 |
| SpA | alum | Newman | 1.4E+07 | 0.41 |
| SasFHis | alum | Newman | 1.4E+07 | 1.33 |
| CoA | alum | Newman | 1.4E+07 | 1.01 |
| Sta028 | alum | Newman | 1.2E+07 | 1.85 |
| Sta017 | alum | Newman | 1.2E+07 | 1.23 |
| Sta006 | alum | Newman | 1.2E+07 | 2.33 |
| Sta012 | alum | Newman | 1.2E+07 | 1.69 |
| Sta011 | alum | Newman | 1.2E+07 | 2.66 |
| Sta019 | alum | Newman | 1.2E+07 | 2.36 |
| Sta021 | alum | Newman | 1.2E+07 | 1.58 |
| IsdA + EsxAB | alum | Newman | 1.8E+07 | 0.11 |
| EsxAB | alum | Newman | 1.8E+07 | 1.31 |
| NW_1 | alum | Newman | 1.8E+07 | 1.00 |
| NW_10 | alum | Newman | 1.8E+07 | −0.65 |
| Sta073 | alum | Newman | 1.8E+07 | 1.46 |
| Sta002 | alum | Newman | 1.8E+07 | 0.17 |
| Sta064 | alum | Newman | 1.8E+07 | 1.04 |
| Sta014 | alum | Newman | 1.8E+07 | 1.74 |
| Sta002 | alum | Newman | 1.0E+07 | 0.52 |
| Sta014 | alum | Newman | 1.0E+07 | 1.02 |
| Sta064 | alum | Newman | 1.0E+07 | 1.22 |
| Sta006 | alum | Newman | 1.0E+07 | 0.80 |
| Sta073 | alum | Newman | 1.0E+07 | 0.92 |
| NW_1 | alum | Newman | 1.0E+07 | 0.77 |
| NW_10 | alum | Newman | 1.0E+07 | 2.25 |
| Sta017 | alum | Newman | 1.0E+07 | 2.13 |
| Sta028 | alum | Newman | 1.0E+07 | 0.64 |
| Sta021 | alum | Newman | 1.0E+07 | 1.03 |
| Sta019 | alum | Newman | 1.0E+07 | 1.28 |
| Sta011 | alum | Newman | 1.0E+07 | 0.78 |
| IsdB | alum | Newman | 1.0E+07 | 1.22 |
| IsdA$_{40-184}$ | none | Newman | 1.0E+07 | 0.58 |
| Sta006 | none | Newman | 1.0E+07 | 0.30 |
| Sta011 | none | Newman | 1.0E+07 | 0.62 |
| EsxAB | none | Newman | 1.0E+07 | 1.09 |
| Sasf | none | Newman | 1.0E+07 | 0.11 |
| IsdB | none | Newman | 1.0E+07 | 0.93 |
| IsdA$_{40-184}$ | alum | Newman | 1.0E+07 | 1.02 |
| Sta006 | alum | Newman | 1.0E+07 | 0.45 |
| Sta011 | alum | Newman | 1.0E+07 | 0.80 |
| EsxAB | alum | Newman | 1.0E+07 | 0.47 |
| Sasf | alum | Newman | 1.0E+07 | −0.78 |
| IsdB | alum | Newman | 1.0E+07 | 1.24 |
| Type 5 conjugate + IsdA$_{40-184}$ | alum | Newman | 1.5E+07 | 0.34 |
| Type 5 conjugate | alum | Newman | 1.5E+07 | 0.72 |
| IsdA$_{40-184}$ | alum | Newman | 1.5E+07 | 1.08 |
| Type 5 conjugate | MF59 | Newman | 1.5E+07 | 0.45 |
| IsdB | alum | Newman | 1.5E+07 | 1.50 |
| ClfB$_{45-552}$ | alum | Newman | 1.5E+07 | −0.05 |
| Sta019 | alum | Newman | 1.5E+07 | 0.82 |
| IsdA$_{40-184}$ + ClfB$_{45-552}$ | alum | Newman | 1.5E+07 | 0.72 |
| Type 8 conjugate | alum | Becker | 4.0E+07 | 1.51 |
| Type 8 conjugate | MF59 | Becker | 4.0E+07 | 0.35 |
| EsxAB + Sta019 + Sta006 + Sta011 | alum | Newman | 1.0E+07 | 1.54 |
| combo1 | alum | Newman | 1.0E+07 | 2.04 |
| EsxAB + IsdA$_{40-184}$ + Sta006 + Sta011 | alum | Newman | 1.0E+07 | 0.84 |
| SdrD$_{53-592}$ | alum | Newman | 1.0E+07 | 1.15 |
| Sta105 | alum | Newman | 1.0E+07 | 0.54 |
| Sta101 | alum | Newman | 1.0E+07 | 1.51 |
| Sta116 | alum | Newman | 1.0E+07 | 1.23 |
| Sta106 | alum | Newman | 1.0E+07 | 1.20 |
| Sta107 | alum | Newman | 1.0E+07 | 1.77 |
| Sta004 | alum | Newman | 1.0E+07 | 0.70 |
| Sta003 | alum | Newman | 1.0E+07 | 1.32 |
| EsxAB + Sta019 + Sta006 + Sta011 | alum | Newman | 9.0E+06 | 3.04 |
| combo1 | alum | Newman | 9.0E+06 | 2.53 |
| EsxAB + IsdA$_{40-184}$ + Sta006 + Sta011 | alum | Newman | 9.0E+06 | 1.85 |
| SdrD$_{53-592}$ | alum | Newman | 9.0E+06 | 1.80 |
| Sta105 | alum | Newman | 9.0E+06 | 0.60 |
| Sta101 | alum | Newman | 9.0E+06 | 0.83 |
| Sta116 | alum | Newman | 9.0E+06 | 1.96 |
| Sta106 | alum | Newman | 9.0E+06 | 2.56 |
| IsdB | alum | Newman | 9.0E+06 | 1.37 |
| Sta004 | alum | Newman | 9.0E+06 | 1.01 |
| Sta003 | alum | Newman | 9.0E+06 | 2.20 |
| IsdB | alum | Newman | 1.0E+07 | 0.83 |
| Sta107 | alum | Newman | 1.0E+07 | 0.24 |
| SrdC$_{51-518}$ | alum | Newman | 1.0E+07 | 0.84 |

TABLE 2-continued

ABSCESS MODEL RESULTS SUMMARY

| Immunising antigen(s) | Adjuvant | infecting strain & dose | | Reduction** |
|---|---|---|---|---|
| SdrE$_{53-632}$ | alum | Newman | 1.0E+07 | 1.08 |
| Hla$_{27-76}$ | alum | Newman | 1.0E+07 | 0.18 |
| EsxAB + HlaH35L + Sta006 + Sta021 | alum | Newman | 1.0E+07 | 0.59 |
| EsxAB + HlaH35L + Sta006 + Sta019 | alum | Newman | 1.0E+07 | 0.85 |
| EsxAB + HlaH35L + Sta006 + Sta017 | alum | Newman | 1.0E+07 | 1.88 |
| EsxAB + Hla27-76 + Sta006 + Sta021 | alum | Newman | 1.0E+07 | 1.49 |
| Hla$_{27-76}$ + Sta006 + Sta017 + Sta019 | alum | Newman | 1.0E+07 | 0.00 |
| IsdB | alum | Newman | 1.2E+07 | 1.07 |
| Sta107 | alum | Newman | 1.2E+07 | 1.35 |
| SrdC$_{51-518}$ | alum | Newman | 1.2E+07 | 2.17 |
| SdrE$_{53-632}$ | alum | Newman | 1.2E+07 | 2.82 |
| Hla$_{27-76}$ | alum | Newman | 1.2E+07 | 0.17 |
| EsxAB + HlaH35L + Sta006 + Sta021 | alum | Newman | 1.2E+07 | 1.70 |
| EsxAB + HlaH35L + Sta006 + Sta019 | alum | Newman | 1.2E+07 | 1.20 |
| EsxAB + HlaH35L + Sta006 + Sta017 | alum | Newman | 1.2E+07 | 1.52 |
| EsxAB + Hla$_{27-76}$ + Sta006 + Sta021 | alum | Newman | 1.2E+07 | 1.81 |
| Hla$_{27-76}$ + Sta006 + Sta017 + Sta019 | alum | Newman | 1.2E+07 | 0.89 |
| IsdB | alum | Mu-50 | 3.8E+07 | 0.44 |
| Combo1 | alum | Mu-50 | 3.8E+07 | 1.73 |
| IsdB | alum | USA 200 | 2.0E+07 | 1.17 |
| Combo1 | alum | USA 200 | 2.0E+07 | 1.87 |
| IsdB | alum | USA 300 | 3.0E+07 | 0.09 |
| Combo1 | alum | USA 300 | 3.0E+07 | 2.19 |
| IsdB | alum | Staph19 | 2.7E+07 | 0.66 |
| Combo1 | alum | Staph19 | 2.7E+07 | 0.46 |
| IsdB | alum | Mu-50 | 4.5E+07 | 0.98 |
| Combo1 | alum | Mu-50 | 4.5E+07 | 0.76 |
| IsdB | alum | USA 200 | 1.6E+07 | 0.18 |
| Combo1 | alum | USA 200 | 1.6E+07 | 0.19 |
| IsdB | alum | USA 300 | 2.2E+07 | −0.21 |
| Combo1 | alum | USA 300 | 2.2E+07 | −0.29 |
| IsdB | alum | Staph19 | 2.3E+07 | 0.57 |
| Combo1 | alum | Staph19 | 2.3E+07 | 0.80 |
| IsdB | alum | LAC | 3.50E+07 | 2.67 |
| Sta011 | alum | LAC | 3.50E+07 | 1.35 |
| EsxAB | alum | LAC | 3.50E+07 | 2.21 |
| HlaH35L | alum | LAC | 3.50E+07 | 0.71 |
| Sta006 | alum | LAC | 3.50E+07 | 2.39 |
| Combo1 | alum | LAC | 3.50E+07 | 2.66 |
| IsdB | alum | MW2 | 3.00E+07 | 1.17 |
| Sta011 | alum | MW2 | 3.00E+07 | 0.82 |
| EsxAB | alum | MW2 | 3.00E+07 | 1.39 |
| HlaH35L | alum | MW2 | 3.00E+07 | 0.87 |
| Sta006 | alum | MW2 | 3.00E+07 | 0.91 |
| Combo1 | alum | MW2 | 3.00E+07 | 2.69 |
| IsdB | alum | LAC | 4.00E+07 | 1.54 |
| Sta011 | alum | LAC | 4.00E+07 | 1.95 |
| EsxAB | alum | LAC | 4.00E+07 | 1.31 |
| HlaH35L | alum | LAC | 4.00E+07 | 0.75 |
| Sta006 | alum | LAC | 4.00E+07 | 1.74 |
| Combo1 | alum | LAC | 4.00E+07 | 2.21 |
| IsdB | alum | MW2 | 2.75E+07 | 1.22 |
| Sta011 | alum | MW2 | 2.75E+07 | 1.25 |
| EsxAB | alum | MW2 | 2.75E+07 | 1.16 |
| HlaH35L | alum | MW2 | 2.75E+07 | 1.61 |
| Sta006 | alum | MW2 | 2.75E+07 | 1.13 |
| Combo1 | alum | MW2 | 2.75E+07 | 1.97 |
| Sta011 | alum | Mu-50 | 4.00E+07 | 1.10 |
| EsxAB | alum | Mu-50 | 4.00E+07 | 0.86 |
| HlaH35L | alum | Mu-50 | 4.00E+07 | 0.71 |
| Sta006 | alum | Mu-50 | 4.00E+07 | 1.57 |
| Combo1 | alum | Mu-50 | 4.00E+07 | 1.72 |
| Sta011 | alum | Staph19 | 5.30E+07 | 1.23 |
| EsxAB | alum | Staph19 | 5.30E+07 | 1.19 |
| HlaH35L | alum | Staph19 | 5.30E+07 | 0.65 |
| Sta006 | alum | Staph19 | 5.30E+07 | 2.00 |
| Combo1 | alum | Staph19 | 5.30E+07 | 2.02 |
| Sta011 | alum | Mu-50 | 4.30E+07 | 1.33 |
| EsxAB | alum | Mu-50 | 4.30E+07 | 0.36 |
| HlaH35L | alum | Mu-50 | 4.30E+07 | 0.11 |
| Sta006 | alum | Mu-50 | 4.30E+07 | 1.05 |
| Combo1 | alum | Mu-50 | 4.30E+07 | 1.34 |
| Sta011 | alum | Staph19 | 4.40E+07 | 1.07 |
| EsxAB | alum | Staph19 | 4.40E+07 | 0.94 |
| HlaH35L | alum | Staph19 | 4.40E+07 | 1.19 |
| Sta006 | alum | Staph19 | 4.40E+07 | 2.31 |
| Combo1 | alum | Staph19 | 4.40E+07 | 2.45 |

*alum = aluminium hydroxide
**Log reduction in kidney CFU

REFERENCES

[1] Sheridan (2009) *Nature Biotechnology* 27:499-501.
[2] Kuklin et al. (2006) *Infect Iminun.* 74(4):2215-23.
[3] WO2007/113222.
[4] WO2005/009379.
[5] WO2009/029132.
[6] WO2008/079315.
[7] WO2005/086663.
[8] WO2005/115113.
[9] WO2006/033918.
[10] WO2006/078680.
[11] WO2007/113224.
[12] WO98/10788.
[13] WO2007/053176.
[14] O'Brien et al. (2000) *J Dairy Sci* 83:1758-66.
[15] *Research Disclosure*, 453077 (January 2002).
[16] EP-A-0372501.
[17] EP-A-0378881.
[18] EP-A-0427347.
[19] WO93/17712.
[20] WO94/03208.
[21] WO98/58668.
[22] EP-A-0471177.
[23] WO91/01146.
[24] Falugi et al. (2001) *Eur J Immunol* 31:3816-3824.
[25] Baraldo et al. (2004) *Infect Immun* 72(8):4884-7.
[26] EP-A-0594610.
[27] Ruan et al. (1990) *J Immunol* 145:3379-3384.
[28] WO00/56360.
[29] Kuo et al. (1995) *Infect Immun* 63:2706-13.
[30] Michon et al. (1998) *Vaccine.* 16:1732-41.
[31] WO02/091998.
[32] WO01/72337.
[33] WO00/61761.
[34] WO00/33882
[35] U.S. Pat. No. 4,761,283.
[36] U.S. Pat. No. 4,356,170.
[37] U.S. Pat. No. 4,882,317.
[38] U.S. Pat. No. 4,695,624.
[39] *Mol. Immunol.*, 1985, 22, 907-919
[40] EP-A-0208375.
[41] Bethell G. S. et al., *J. Biol. Chem.*, 1979, 254, 2572-4
[42] Hearn M. T. W., *J. Chromatogr.*, 1981, 218, 509-18
[43] WO00/10599.
[44] Gever et al., Med. Microbiol. Immunol, 165:171-288 (1979).

[45] U.S. Pat. No. 4,057,685.
[46] U.S. Pat. Nos. 4,673,574; 4,761,283; 4,808,700.
[47] U.S. Pat. No. 4,459,286.
[48] U.S. Pat. No. 4,965,338.
[49] U.S. Pat. No. 4,663,160.
[50] WO2007/000343.
[51] WO2008/019162.
[52] Rable & Wardenburg (2009) *Infect Immun* 77:2712-8.
[53] WO2007/145689.
[54] WO2009/029831.
[55] WO2005/079315.
[56] WO2008/152447.
[57] Kim et al. (2010) *Vaccine* doi:10.1016/j.vaccine.2010.02.097
[58] WO2005/009379.
[59] WO2005/009378.
[60] Sjodahl (1977) *J. Biochem.* 73:343-351.
[61] Uhlen et al. (1984) *J. Biol. Chem.* 259:1695-1702 & 13628 (Corr.).
[62] Schneewind et al. (1992) *Cell* 70:267-281.
[63] DeDent et al. (2008) *EMBO J.* 27:2656-2668.
[64] Sjoquist et al. (1972) *Eur. J. Biochem.* 30:190-194.
[65] DeDent et al. (2007) *J. Bacteriol.* 189:4473-4484.
[66] Deisenhofer et al., (1978) *Hoppe-Seyh Zeitsch. Physiol. Chem.* 359:975-985.
[67] Deisenhofer (1981) *Biochemistry* 20:2361-2370.
[68] Graille et al. (2000) *Proc. Nat. Acad. Sci. USA* 97:5399-5404.
[69] O'Seaghdha et al. (2006) *FEBS J.* 273:4831-41.
[70] Gomez et al. (2006) *J. Biol. Chem.* 281:20190-20196.
[71] WO2007/071692.
[72] Sebulsky & Heinrichs (2001) *J. Bacteriol* 183:4994-5000.
[73] Sebulsky et al. (2003) *J. Biol Chem* 278:49890-900.
[74] WO2010/039563.
[75] U.S. Pat. No. 5,707,829
[76] *Current Protocols in Molecular Biology* (F. M. Ausubel et al. eds., 1987) Supplement 30.
[77] Kuroda et al. (2001) *Lancet* 357:1225-1240.
[78] Needleman & Wunsch (1970) *J. Mol. Biol.* 48, 443-453.
[79] Rice et al. (2000) *Trends Genet* 16:276-277.
[80] U.S. Pat. No. 6,355,271.
[81] WO00/23105.
[82] *Vaccine Design* . . . (1995) eds. Powell & Newman. ISBN: 030644867X. Plenum.
[83] WO90/14837.
[84] WO90/14837.
[85] Podda & Del Giudice (2003) *Expert Rev Vaccines* 2:197-203.
[86] Podda (2001) *Vaccine* 19: 2673-2680.
[87] *Vaccine Design: The Subunit and Adjuvant Approach* (eds. Powell & Newman) Plenum Press 1995 (ISBN 0-306-44867-X).
[88] *Vaccine Adjuvants: Preparation Methods and Research Protocols* (Volume 42 of *Methods in Molecular Medicine* series). ISBN: 1-59259-083-7. Ed. O'Hagan.
[89] WO2008/043774.
[90] Allison & Byars (1992) *Res Immunol* 143:519-25.
[91] Hariharan et al. (1995) *Cancer Res* 55:3486-9.
[92] US-2007/014805.
[93] US-2007/0191314.
[94] Suli et al. (2004) *Vaccine* 22(25-26):3464-9.
[95] WO95/11700.
[96] U.S. Pat. No. 6,080,725.
[97] WO2005/097181.
[98] WO2006/113373.
[99] Han et al. (2005) *Impact of Vitamin E on Immune Function and Infectious Diseases in the Aged* at Nutrition, Immune functions and Health EuroConference, Paris, 9-10 June 2005.
[100] U.S. Pat. No. 6,630,161.
[101] U.S. Pat. No. 5,057,540.
[102] WO96/33739.
[103] EP-A-0109942.
[104] WO96/11711.
[105] WO00/07621.
[106] Barr et al. (1998) *Advanced Drug Delivery Reviews* 32:247-271.
[107] Sjolanderet et al. (1998) *Advanced Drug Delivery Reviews* 32:321-338.
[108] Niikura et al. (2002) *Virology* 293:273-280.
[109] Lenz et al. (2001) *J Immunol* 166:5346-5355.
[110] Pinto et al. (2003) *J Infect Dis* 188:327-338.
[111] Gerber et al. (2001) *J Virol* 75:4752-4760.
[112] WO03/024480.
[113] WO03/024481.
[114] Gluck et al. (2002) *Vaccine* 20:B10-B16.
[115] EP-A-0689454.
[116] Johnson et al. (1999) *Bioorg Med Chem Lett* 9:2273-2278.
[117] Evans et al. (2003) *Expert Rev Vaccines* 2:219-229.
[118] Meraldi et al. (2003) *Vaccine* 21:2485-2491.
[119] Pajak et al. (2003) *Vaccine* 21:836-842.
[120] Kandimalla et al. (2003) *Nucleic Acids Research* 31:2393-2400.
[121] WO02/26757.
[122] WO99/62923.
[123] Krieg (2003) *Nature Medicine* 9:831-835.
[124] McCluskie et al. (2002) *FEMS Immunology and Medical Microbiology* 32:179-185.
[125] WO98/40100.
[126] U.S. Pat. No. 6,207,646.
[127] U.S. Pat. No. 6,239,116.
[128] U.S. Pat. No. 6,429,199.
[129] Kandimalla et al. (2003) *Biochemical Society Transactions* 31 (part 3):654-658.
[130] Blackwell et al. (2003) *J Immunol* 170:4061-4068.
[131] Krieg (2002) *Trends Immunol* 23:64-65.
[132] WO01/95935.
[133] Kandimalla et al. (2003) *BBRC* 306:948-953.
[134] Bhagat et al. (2003) *BBRC* 300:853-861.
[135] WO03/035836.
[136] WO01/22972.
[137] Schellack et al. (2006) *Vaccine* 24:5461-72.
[138] Kamath et al. (2008) *Eur J Immunol* 38:1247-56.
[139] Riedl et al. (2008) *Vaccine* 26:3461-8.
[140] WO95/17211.
[141] WO98/42375.
[142] Beignon et al. (2002) *Infect Immun* 70:3012-3019.
[143] Pizza et al. (2001) *Vaccine* 19:2534-2541.
[144] Pizza et al. (2000) *Int J Med Microbiol* 290:455-461.
[145] Scharton-Kersten et al. (2000) *Infect Immun* 68:5306-5313.
[146] Ryan et al. (1999) *Infect Immun* 67:6270-6280.
[147] Partidos et al. (1999) *Immunol Lett* 67:209-216.
[148] Peppoloni et al. (2003) *Expert Rev Vaccines* 2:285-293.
[149] Pine et al. (2002) *J Control Release* 85:263-270.
[150] Tebbey et al. (2000) *Vaccine* 18:2723-34.
[151] Domenighini et al. (1995) *Mol Microbiol* 15:1165-1167.
[152] WO99/40936.
[153] WO99/44636.
[154] Singh et al] (2001) *J Cont Release* 70:267-276.

[155] WO99/27960.
[156] U.S. Pat. No. 6,090,406.
[157] U.S. Pat. No. 5,916,588.
[158] EP-A-0626169.
[159] WO99/52549.
[160] WO01/21207.
[161] WO01/21152.
[162] Andrianov et al. (1998) *Biomaterials* 19:109-115.
[163] Payne et al. (1998) *Adv Drug Delivery Review* 31:185-196.
[164] U.S. Pat. No. 4,680,338.
[165] U.S. Pat. No. 4,988,815.
[166] WO92/15582.
[167] Stanley (2002) *Clin Exp Dermatol* 27:571-577.
[168] Wu et al. (2004) *Antiviral Res.* 64(2):79-83.
[169] Vasilakos et al. (2000) *Cell Immunol.* 204(1):64-74.
[170] U.S. Pat. Nos. 4,689,338, 4,929,624, 5,238,944, 5,266,575, 5,268,376, 5,346,905, 5,352,784, 5,389,640, 5,395,937, 5,482,936, 5,494,916, 5,525,612, 6,083,505, 6,440,992, 6,627,640, 6,656,938, 6,660,735, 6,660,747, 6,664,260, 6,664,264, 6,664,265, 6,667,312, 6,670,372, 6,677,347, 6,677,348, 6,677,349, 6,683,088, 6,703,402, 6,743,920, 6,800,624, 6,809,203, 6,888,000 and 6,924,293.
[171] Jones (2003) *Curr Opin Investig Drugs* 4:214-218.
[172] WO03/011223.
[173] Johnson et al. (1999) *Bioorg Med Chem Lett* 9:2273-2278.
[174] Evans et al. (2003) *Expert Rev Vaccines* 2:219-229.
[175] Hu et al. (2009) *Vaccine* 27:4867-73.
[176] WO2004/060308.
[177] WO2004/064759.
[178] U.S. Pat. No. 6,924,271.
[179] US2005/0070556.
[180] U.S. Pat. No. 5,658,731.
[181] U.S. Pat. No. 5,011,828.
[182] WO2004/87153.
[183] U.S. Pat. No. 6,605,617.
[184] WO02/18383.
[185] WO2004/018455.
[186] WO03/082272.
[187] Wong et al. (2003) *J Clin Pharmacol* 43(7):735-42.
[188] US2005/0215517.
[189] Dyakonova et al. (2004) Int Immunopharmacol 4(13):1615-23.
[190] FR-2859633.
[191] Signorelli & Hadden (2003) *Int Immunopharmacol* 3(8):1177-86.
[192] WO2004/064715.
[193] De Libero et al, *Nature Reviews Immunology,* 2005, 5: 485-496
[194] U.S. Pat. No. 5,936,076.
[195] Oki et al, *J. Clin. Investig.,* 113: 1631-1640
[196] US2005/0192248
[197] Yang et al, *Angew. Chem. Int. Ed.,* 2004, 43: 3818-3822
[198] WO2005/102049
[199] Goff et al, *J. Am. Chem., Soc.,* 2004, 126: 13602-13603
[200] WO03/105769
[201] Cooper (1995) *Pharm Biotechnol* 6:559-80.
[202] WO99/11241.
[203] WO94/00153.
[204] WO98/57659.
[205] European patent applications 0835318, 0735898 and 0761231.
[206] WO2006/110603.
[207] Stranger-Jones et al. (2006) *PNAS USA* 103:16942-7.
[208] Wardenburg et al. (2007) *Infect Immun* 75:1040-4.
[209] Donnelly et al. (1997) *Annu Rev Immunol* 15:617-648.
[210] Strugnell et al. (1997) *Immunol Cell Biol* 75(4):364-369.
[211] Cui (2005) *Adv Genet* 54:257-89.
[212] Robinson & Torres (1997) *Seminars in Immunol* 9:271-283.
[213] Brunham et al. (2000) *J Infect Dis* 181 Suppl 3:S538-43.
[214] Svanholm et al. (2000) *Scand J Immunol* 51(4):345-53.
[215] *DNA Vaccination—Genetic Vaccination* (1998) eds. Koprowski et al. (ISBN 3540633928).
[216] *Gene Vaccination: Theory and Practice* (1998) ed. Raz (ISBN 3540644288).
[217] Findeis et al., *Trends Biotechnol.* (1993) 11:202
[218] Chiou et al. (1994) *Gene Therapeutics: Methods And Applications Of Direct Gene Transfer.* ed. Wolff
[219] Wu et al., *J. Biol. Chem.* (1988) 263:621
[220] Wu et al., *J. Biol. Chem.* (1994) 269:542
[221] Zenke et al., *Proc. Natl. Acad. Sci. (USA)* (1990) 87:3655
[222] Wu et al., *J. Biol. Chem.* (1991) 266:338
[223] Jolly, *Cancer Gene Therapy* (1994) 1:51
[224] Kimura, *Human Gene Therapy* (1994) 5:845
[225] Connelly, *Human Gene Therapy* (1995) 1:185
[226] Kaplitt, *Nature Genetics* (1994) 6:148
[227] WO 90/07936.
[228] WO 94/03622.
[229] WO 93/25698.
[230] WO 93/25234.
[231] U.S. Pat. No. 5,219,740.
[232] WO 93/11230.
[233] WO 93/10218.
[234] U.S. Pat. No. 4,777,127.
[235] GB Patent No. 2,200,651.
[236] EP-A-0345242.
[237] WO 91/02805.
[238] WO 94/12649.
[239] WO 93/03769.
[240] WO 93/19191.
[241] WO 94/28938.
[242] WO 95/11984.
[243] WO 95/00655.
[244] Curiel, *Hum. Gene Ther.* (1992) 3:147
[245] Wu, *J. Biol. Chem.* (1989) 264:16985
[246] U.S. Pat. No. 5,814,482.
[247] WO 95/07994.
[248] WO 96/17072.
[249] WO 95/30763.
[250] WO 97/42338.
[251] WO 90/11092.
[252] U.S. Pat. No. 5,580,859
[253] U.S. Pat. No. 5,422,120
[254] WO 95/13796.
[255] WO 94/23697.
[256] WO 91/14445.
[257] EP-0524968.
[258] Philip, *Mol. Cell Biol.* (1994) 14:2411
[259] Woffendin, *Proc. Natl. Acad. Sci.* (1994) 91:11581
[260] U.S. Pat. No. 5,206,152.
[261] WO 92/11033.
[262] U.S. Pat. No. 5,149,655.
[263] Winter et al., (1991) *Nature* 349:293-99
[264] U.S. Pat. No. 4,816,567.
[265] Inbar et al., (1972) *Proc. Natl. Acad. Sci. U.S.A.* 69:2659-62.
[266] Ehrlich et al., (1980) *Biochem* 19:4091-96.
[267] Huston et al., (1988) *Proc. Natl. Acad. Sci. U.S.A.* 85:5897-83.

[268] Pack et al., (1992) Biochem 31, 1579-84.
[269] Cumber et al., (1992) J. Immunology 149B, 120-26.
[270] Riechmann et al., (1988) Nature 332, 323-27.
[271] Verhoeyan et al., (1988) Science 239, 1534-36.
[272] GB 2,276,169.
[273] Gennaro (2000) Remington: The Science and Practice of Pharmacy. 20th edition, ISBN: 0683306472.
[274] Methods In Enzymology (S. Colowick and N. Kaplan, eds., Academic Press, Inc.)
[275] Handbook of Experimental Immunology, Vols. I-IV (D. M. Weir and C. C. Blackwell, eds, 1986, Blackwell Scientific Publications)
[276] Sambrook et al. (2001) Molecular Cloning: A Laboratory Manual, 3rd edition (Cold Spring Harbor Laboratory Press).
[277] Handbook of Surface and Colloidal Chemistry (Birdi, K. S. ed., CRC Press, 1997)
[278] Ausubel et al. (eds) (2002) Short protocols in molecular biology, 5th edition (Current Protocols).
[279] Molecular Biology Techniques: An Intensive Laboratory Course, (Ream et al., eds., 1998, Academic Press)
[280] PCR (Introduction to Biotechniques Series), 2nd ed. (Newton & Graham eds., 1997, Springer Verlag)
[281] Geysen et al. (1984) PNAS USA 81:3998-4002.
[282] Carter (1994) Methods Mol Biol 36:207-23.
[283] Jameson, B A et al. 1988, CABIOS 4(1):181-186.
[284] Raddrizzani & Hammer (2000) Brief Bioinform 1(2): 179-89.
[285] Bublil et al. (2007) Proteins 68(1):294-304.
[286] De Lalla et al. (1999) J. Immunol. 163:1725-29.
[287] Kwok et al. (2001) Trends Immunol 22:583-88.
[288] Brusic et al. (1998) Bioinformatics 14(2):121-30
[289] Meister et al. (1995) Vaccine 13(6):581-91.
[290] Roberts et al. (1996) AIDS Res Hum Retroviruses 12(7): 593-610.
[291] Maksyutov & Zagrebelnaya (1993) Comput Appl Biosci 9(3):291-7.
[292] Feller & de la Cruz (1991) Nature 349(6311):720-1.
[293] Hopp (1993) Peptide Research 6:183-190.
[294] Welling et al. (1985) FEBS Lett. 188:215-218.
[295] Davenport et al. (1995) Immunogenetics 42:392-297.
[296] Tsurui & Takahashi (2007) J Pharmacol Sci. 105(4): 299-316.
[297] Tong et al. (2007) Brief Bioinform. 8(2):96-108.
[298] Schirle et al. (2001) J Immunol Methods. 257(1-2):1-16.
[299] Chen et al. (2007) Amino Acids 33(3):423-8.
[300] Current Protocols in Molecular Biology (F. M. Ausubel et al., eds., 1987) Supplement 30
[301] Smith & Waterman (1981) Adv. Appl. Math. 2: 482-489.
[302] Doro et al. (2009) Molecular & Cellular Proteomics 8:1728-1737.
[303] Chao & Birkbeck (1978) J Med Microbiol 11(3): 303-13.
[304] Guex & Peitsch (1997) Electrophoresis 18(15): 2714-23.
[305] Laskowski et al. (1993) J Appl Cryst 26: 283-291.
[306] Ludtke et al. (1999) J Struct Biol 128(1): 82-97.
[307] Mindell & Grigorieff (2003) J Struct Biol 142(3): 334-47.
[308] Pettersen et al. (2004) J Comput Chem 25(13): 1605-12.
[309] Rost et al. (2004) Nucleic Acids Res 32 (Web Server issue): W321-6.
[310] Song et al. (1996) Science 274(5294): 1859-66.
[311] van Heel et al. (1996) J Struct Biol 116(1): 17-24.
[312] Kawate & Gouaux (2003) Protein Sci. 12(5): 997-1006.
[313] Burton et al. (1981) Lipids 16(12): 946.

SEQUENCE LISTING (250 sequences)

SEQ ID NO: 1 - protein, 927 aa, Staphylococcus aureus
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPVAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYIDPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSDNDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSDSDSDSDSDSDSDSDSDSDSDSDSDSDSDSESDSDSDSDSDSDSDSDSDSDSDSASDSDSGSDSDSSSDSDSESDSNSDSESVSNNNVVPPNSPKNGTNASNKNEAKDSKEPLPDTGSEDEANTSLIWGLLASIGSLLLFRRKKENKDKK

SEQ ID NO: 2 - protein, 877 aa, Staphylococcus aureus
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 3 - protein, 636 aa, Staphylococcus aureus
MKKQIISLGALAVASSLFTWDNKADAIVTKDYSGKSQVNAGSKNGTLIDSRYLNSALYYLEDYIIYAIGLTNKYEYGDNIYKEAKDRLLEKVLREDQYLLERKKSQYEDYKQWYANYKKENPRTDLKMANFHKYNLEELSMKEYNELQDALKRALDDFHREVKDIKDKNSDLKTFNAAEEDKATKEVYDLVSEIDTLVVSYYGDKDYGEHAKELRAKLDLILGDTDNPHKITNERIKKEMIDDLNSIIDDFFMETKQNRPKSITKYNPTTHNYKTNSDNKPNFDKLVEETKKAVKEADDSWKKKTVKKYGETETKSPVVKEEKKVEEPQAPKVDNQQEVKTTAGKAEETTQPVAQPLVKIPQGTITGEIVKGPEYPTMENKTVQGEIVQGPDFLTMEQSGPSLSNNYTNPPLTNPILEGLEGSSSKLEIKPQGTESTLKGTQGESSDIEVKPQATETTEASQYGPRPQFNKTPKYVKYRDAGTGIREYNDGTFGYEARPRFNKPSETNAYNVTTHANGQVSYGARPTYKKPSETNAYNVTTHANGQVSYGARPTQNKPSKTNAYNVTTHGNGQVSYGARPTQNKPSKTNAYNVTTHANGQVSYGARPTYKKPSKTNAYNVTTHADGTATYGPRVTK

SEQ ID NO: 4 - protein, 584 aa, Staphylococcus aureus
MKFKSLITTTLALGVLASTGANFNNNEASAAAKPLDKSSSSLHHGYSKVHVPYAITVNGTSQNILSSLTFNKNQNISYKDLEDRVKSVLKSDRGISDIDLRLSKQAKYTVYFKNGTKKVIDLKAGIYTADLINTSEIKAININVDTKKQVEDKKKDKANYQVPYTITVNGTSQNILSNLTFNKNQNISYKDLEDKVKSVLESNRGITDVDLRLSKQAKYTVNFKNGTKKVIDLKSGIYTANLINSSDIKSININVDTKKHIENKAKRNYQVPYSINLNGTSTNILSNLSFSNKPWTNYKNLTSQIKSVLKHDRGISEQDLKYAKKAYYTVYFKNGGKRILQLNSKNYTANLVHAKDVKRIEITVKTGTKAKADRYVPYTIAVNGTSTPILSDLKFTGDPRVGYKDISKKVKSVLKHDRGIGERELKYAKKATYTVHFKNGTKKVININSNISQLNLLYVQDIKKIDIDVKTGTKAKADSYVPYTIAVNGTSTPILSKLKISNKQLISYKYLNDKVKSVLKSERGISDLDLKFAKQAKYTVYFKNGKKQVVNLKSDIFTPNLFSAKDIKKIDIDVKQYTKSKKNK

SEQ ID NO: 5 - protein, 9535 aa, Staphylococcus aureus
MNYRDKIQKFSIRKYTVGTFSTVIATLVFLGFNTSQAHAAETNQPASVVKQKQQSNNEQTENRESQVQNSQNSQNGQSLSATHENEQPNISQANLVDQKVAQSSTTNDEQPASQNVNTKKDSATAATTQPDKEQSKHKQNESQSANKNGNDNRAAHVENHEANVVTASDSSDNGNVQHDRNELQAFFDANYHDYRFIDRENADSGTFNYVKGIFDKINTLLGSNDPINNKDLQLAYKELEQAVALIRTMPQRQQTSRRSNRIQTRSVESRAAEPRSVSDYQNANSSYYVENANDGSGYPVGTYINASSKGAPYNLPTTPWNTLKASDSKEIALMTAKQTGDGYQWVIKFNKGHAPHQNMIFWFALPADQVPVGRTDFVTVNSDGTNVQWSHGAGAGANKPLQQMWEYGVNDPHRSHDFKIRNRSGQVIYDWPTVHIYSLEDLSRASDYFSEAGATPATKAFGRQNFEYINGQKPAESPGVPKVYTFIGQGDASYTISFKTQGPTVNKLYYAAGGRALEYNQLFMYSQLYVESTQDHQQRLNGLRQVVNRTYRIGTTKRVEVSQGNVQTKKVLESTNLNIDDFVDDPLSYVKTPSNKVLGFYSNNANTNAFRPGGAQQLNEYQLSQLFTDQKLQEAARTRNPIRLMIGFDYPDAYGNSETLVPVNLTVLPEIQHNIKFFKNDDTQNIAEKPFSKQAGHPVFYVYAGNQGNASVNLGGSVTSIQPLRINLTSNENFTDKDWQITGIPRTLHIENSTNRPNNARERNIELVGNLLPGDYFGTIRFGRKEQLFEIRVKPHTPTITTTAEQLRGTALQKVPVNISGIPLDPSALVYLVAPTNQTTNGGSEADQIPSGYTILATGTPDGVHNTITIRPQDYVVFIPPVGKQIRAVVYYNKVVASNMSNAVTILPDDIPPTINNPVGINAKYYRGDEVNFTMGVSDRHSGIKNTTITTLPNGWTSNLTKADKNNGSLSITGRVSMNQAFNSDITFKVSATDNVNNTTNDSQSKHVSIHVGKISEDAHPIVLGNTEKVVVVNPTAVSNDEKQSIITAFMNKNQNIRGYLASTDPVTVDNNGNVTLHYRDGSSTTLDATNVMTYEPVVKPEYQTVNAAKTATVTIAKGQSFSIGDIKQYFTLSNGQPIPSGTFTNITSDRTIPTAQEVSQMNAGTQLYHITATNAYHKDSEDFYISLKIIDVKQPEGDQRVYRTSTYDLTTDEISKVKQAFINANRDVITLAEGDISVTNTPNGANVSTITVNINKGRLTKSFASNLANMNFLRWVNFPQDYTVTWTNAKIANRPTDGGLSWSDDHKSLIYRYDATLGTQITTNDILTMLKATTTVPGLRNNITGNEKSQAEAGGRPNFRTTGYSQSNATTDGQRQFTLNGQVIQVLDIINPSNGYGGQPVTNSNTRANHSNSTVVNVNEPAANGAGAFTIDHVVKSNSTHNASDAVYKAQLYLTPYGPKQYVEHLNQNTGNTTDAINIYFVPSDLVNPTISVGNYTNHQVFSGETFTNTITANDNFGVQSVTVPNTSQITGTVDNNHQHVSATAPNVTSATNKTINLLATDTSGNTATTSFNVTVKPLRDKYRVGTSSTAANPVRIANISNNATVSQADQTTIINSLTFTETVPNRSYARASANEITSKTVSNVSRTGNNANVTVTVTYQDGTTSTVTVPVKHVIPEIVAHSHYTVQGQDFPAGNGSSASDYFKLSNGSDIADATITWVSGQAPNKDNTRIGEDITVTAHILIDGETTPITKTATYKVVRTVPKHVFETARGVLYPGVSDMYDAKQYVKPVNNSWSTNAQHMNFQFVGTYGPNKDVVGISTRLIRVTYDNRQTEDLTILSKVKPDPPRIDANSVTYKAGLTNQEIKVNNVLNNSSVKLFKADNTPLNVTNITHGSGFSSVVTVSDALPNGGIKAKSSISMNNVTYTTQDEHGQVVTVTRNESVDSNDSATVTVTPQLQATTEGAVFIKGGDGFDFGHVERFIQNPPHGATVAWHDSPDTWKNTVGNTHKTAVVTLPNGQGTRNVEVPVKVYPVANAKAPSRDVKGQNLTNGTDAMNYITFDPNTNTNGITAAWANRQQPNNQQAGVQHLNVDVTYPGISAAKRVPVTVNVYQFEFPQTTYTTTVGGTLASGTQASGYAHMQNATGLPTDGFTYKWNRDTTGTNDANWSAMNKPNVAKVVNAKYDVIYNGHTFATSLPAKFVVKDVQPAKPTVTETAAGAITIAPGANQTVNTHAGNVTTYADKLVIKRNGNVVTTFTRRNNTSPWVKEASAATVAGIAGTNNGITVAAGTFNPADTIQVVATQGSGETVSDEQRSDDFTVVAPQPNQATTKIWQNGHIDITPNNPSGHLINPTQAMDIAYTEKVGNGAEHSKTINVVRGQNNQWTIANKPDYVTLDAQTGKVTFNANTIKPNSSITITPKAGTGHSVSSNPSTLTAPAAHTVNTTEIVKDYGSNVTAAEINNAVQVANKRTATIKNGTAMPTNLAGGSTTTIPVTVTYNDGSTEEVQESIFTKADKRELITAKNHLDDPVSTEGKKPGTITQYNNAMHNAQQQINTAKTEAQQVINNERATPQQVSDALTKVRAAQTKIDQAKALLQNKEDNSQLVTSKNNLQSSVNQVPSTAGMTQQSIDNYNAKKREAETEITAAQRVIDNGDATAQQISDEKHRVDNALTALNQAKHDLTADTHALEQAVQQLNRTGTTTGKKPASITAYNNSIRALQSDLTSAKNSANAIIQKPIRTVQEVQSALTNVNRVNERLTQAINQLVPLADNSALKTAKTKLDEEINKSVTTDGMTQSSIQAYENAKRAGQTESTNAQNVINNGDATDQQIAAEKTKVEEKYNSLKQAIAGLTPDLAPLQTAKTQLQNDIDQPTSTTGMTSASIAAFNEKLSAARTKIQEIDRVLASHPDVATIRQNVTAANAAKSALDQARNGLTVDKAPLENAKNQLQHSIDTQTSTTGMTQDSINAYNAKLTAARNKIQQINQVLAGSPTVEQINTNTSTANQAKSDLDHARQALTPDKAPLQTAKTQLEQSINQPTDTTGMTTASLNAYNQKLQAARQKLTEINQVLNGNPTVQNINDKVTEANQAKDQLNTARQGLTLDRQPALTTLHGASNLNQAQQNNFTQQINAAQNHAALETIKSNITALNTAMTKLKDSVADNNTIKSDQNYTDATPANKQAYDNAVNAAKGVIGETTNPTMDVNTVNQKAASVKSTKDALDGQQNLQRAKTEATNAITHASDLNQAQKNALTQQVNSAQNVQAVNDIKQTTQSLNTAMTGLKRGVANHNQVVQSDNYVNADTNKKNDYNNAYNHANDIINGNAQHPVITPSDVNNALSNVTSKEHALNGEAKLNAAKQEANTALGHLNNLNNAQRQNLQSQINGAHQIDAVNTIKQNATNLNSAMGNLRQAVADKDQVKRTEDYADADTAKQNAYNSAVSSAETIINQTTNPTMSVDDVNRATSAVTSNKNALNGYEKLAQSKTDAARAIDALPHLNNAQKADVKSKINAASNIAGVNTVKQQGTDLNTAMGNLQGAINDEQTTLNSQNYQDATPSKKTAYTNAVQAAKDILNKSNGQNKTKDQVTEAMNQVNSAKNNLDGTRLLDQAKQTAKQQLNNMTHLTTAQKTNLTNQINSGTTVAGVQTVQSNANTLDQAMNTLRQSIANKDATKASEDYVDANNDKQTAYNNAVAAAETIINANSNPEMNPSTITQKAEQVNSSKTALNGDENLAAAKQNAKTYLNTLTSITDAQKNNLISQITSATRVSGVDTVKQNAQHLDQAMASLQNGINNESQVKSSEKYRDADTNKQQEYDNAITAAKAILNKSTGPNTAQNAVEAALQRVNNAKDALNGDAKLIAAQNAAKQHLGTLTHITTAQRNDLTNQISQATNLAGVESVKQNANSLDGAMGNLQTAINDKSGTLASQNFLDADEQKRNAYNQAVSAAETILNKQTGPNTAKTAVEQALNNVNNAKHALNGTQNLNNAKQAAITAINGASDLNQKQKDALKAQANGAQRVSNAQDVQHNATELNTAMGTLKHAIADKTNTLASSKYVNADSTKQNAYTTKVTNAEHIISGTPTVVTTPSEVTAAANQVNSAKQELNGDERLREAKQNANTAIDALTQLNTPQKAKLKEQVGQANRLEDVQTVQTNGQALNNAMKGLRDSIANETTVKTSQNYTDASPNNQSTYNSAVSNAKGIINQTNNPTMDTSAITQATTQVNNAKNGLNGAENLRNAQNTAKQNLNTLSHLTNNQKSAISSQIDRAGHVSEVTATKNAATELNTQMGNLEQAIHDQNTVKQSVKFTDADKAKRDAYTNAVSRAEAILNKTQGANTSKQDVEAAIQNVSSAKNALNGDQNVTNAKNAAKNALNNLTSINNAQKRDLTTKIDQATTVAGVEAVSNTSTQLNTAMANLQNGINDKTNTLASENYHDADSDKKTAYTQAVTNAENILNKNSGSNLDKTAVENALSQVANAKGALNGNHNLEQAKSNANTTINGLQHLTTAQKDKLKQQVQQAQNVAGVDTVKSSANTLNGAMGTLRNSIQDNTATKNGQNYLDATERNKTNYNNAVDSANGVINATSNPNMDANAINQIATQVTSTKNALDGTHNLTQAKQTATNAIDGATNLNKAQKDALKAQVTSAQRVANVTSIQQTANELNTAMGQLQHGIDDENATKQTQKYRDAEQSKKTAYDQAVAAAKAILNKQTGSNSDKAAVDRALQQVTSTKDALNGDAKLAEAKAAAKQNLGTLNHITNAQRTDLEGQINQATTVDGVNTVKTNANTLDGAMNSLQGSINDKDATLRNQNYLDADESKRNAYTQAVTAAEGILNKQTGGNTSKADVDNALNAVTRAKAALNGADNLRNAKTSATNTIDGLPNLTQLQKDNLKHQVEQAQNVAGVNGVKDKGNTLNTAMGALRTSIQNDNTTKTSQNYLDASDSNKNNYNTAVNNANGVINATNNPNMDANAINGMANQVNTTKAALNGAQNLAQAKTNATNTINNAHDLNQKQKDALKTQVNNAQRVSDANNVQHTATELNSAMTALKAAIADKERTKASGNYVNADQEKRQAYDSKVTNAENIISGTPNATLTVNDVNSAASQVNAAKTALNGDNNLRVAKEHANNTIDGLAQLNNAQKAKLKEQVQSATTLDGVQTVKNSSQTLNTAMKGLRDSIANEATIKAGQNYTDASPNNRNEYDSAVTAAKAIINQTSNPTMEPNTITQVTSQVTTKEQALNGARNLAQAKTTAKNNLNNLTSINNAQKDALTRSIDGATTVAGVNQETAKATELNNAMHSLQNGINDETQTKQTQKYLDAEPSKKSAYDQAVNAAKAILTKASGQNVDKAAVEQALQNVNSTKTALNGDAKLNEAKAAAKQTLGTLTHINNAQRTALDNEITQATNVEGVNTVKAKAQQLDGAMGQLETSIRDKDTTLQSQNYQDADDAKRTAYSQAVNAAATILNKTAGGNTPKADVERAMQAVTQANTALNGIQNLDRAKQAANTAITNASDLNTKQKEALKAQVTSAGRVSAANGVEHTATELNTAMTALKRAIADKAETKASGNYVNADANKRQAYDEKVTAAENIVSGTPTPTLTPADVTNAATQVTNAKTQLNGNHNLEVAKQNANTAIDGLTSLNGPQKAKLKEQVGQATTLPNVQTVRDNAQTLNTAMKGLRDSIANEATIKAGQNYTDASQNKQTDYNSAVTAAKAIIGQTTSPSMNAQEINQAKDQVTAKQQALNGQENLRTAQTNAKQHLNGLSDLTDAQKDAVKRQIEGATHVNEVTQAQNNADALNTAMTNLKNGIQDQNTIKQGVNFTDADEAKRNAYTNAVTQAEQILNKAQGPNTSKDGVETALENVQRAKNELNGNQNVANAKTTAKNALNNLTSINNAQKEALKSQIEGATTVAGVNQVSTTASELNTAMSNLQNGINDEAATKAALNGTQNLEKAKQHANTAIDGLSHLTNAQKEALKQLVQQSTTVAEAQGNEQKANNVDAAMDKLRQSIADNATTKQNQNYTDASQNKKDAYNNAVTTAQGIIDQTTSPTLDPTVINQAAGQVSTTKNALNGNENLEAAKQQASQSLGSLDNLNNAQKQTVTDQINGAHTVDEANQIKQNAQNLNTAMGNLKQAIADKDATKATVNFTDADQAKQQAYNTAVTNAENIISKANGGNATQAEVEQAIKQVNAAKQALNGNANVQHAKDEATALINSSNDLNQAQKDALKQQVQNATTVAGVNNVKQTAQELNNAMTQLKQGIADKEQTKADGNFVNADPDKQNAYNQAVAKAEALISATPDVVVTPSEITAALNKVTQAKNDLNGNTNLATAKQNVQHAIDQLPNLNQAQRDEYSKQITQATLVPNVNAIQQAATTLNDAMTQLKQGIANKAQIKGSENYHDADTDKQTAYDNAVTKAEELLKQTTNPTMDPNTIQQALTKVNDTNQALNGNQKLADAKQDAKTTLGTLDHLNDAQKQALTTQVEQAPDIATVNNVKQNAQNLNNAMTNLNNALQDKTETLNSINFTDADQAKKDAYTNAVSHAEGILSKANGSNASQTEVEQAMQRVNEAKQALNGNDNVQRAKDAAKQVITNANDLNQAMTQLKQGIADKDQTKANGNFVNADTDKQNAYNNAVAHAEQIISGTPNANVDPQQVAQALQQVNQAKGDLNGNHNLQVAKDNANTAIDQLPNLNQPQKTALKDQVSHAELVTGVNAIKQNADALNNAMGTLKQQIQANSQVPQSVDFTQADQDKQQAYNNAANQAQQIANGIPTPVLTPDTVTQAVTTMNQAKDALNGDEKLAQAKQEALANLDTLRDLNQPQRDALRNQINQAQALATVEQTKQNAQNVNTAMSNLKQGIANKDTVKASENYHDADADKQTAYTNAVSQAEGIINQTTNPTLNPDEITRALTQVTDAKNGLNGEAKLATEKQNAKDAVSGMTHLNDAQKQALKGQIDQSPEIATVNQVKQTATSLDQAMDQLSQAINDKAQTLADGNYLNADPDKQNAYKQAVAKAEALLNKQSGTNEVQAQVESITNEVNAAKQALNGNDNLANAKQQAKQQLANLTHLNDAQKQSFESQITQAPLVTDVTTINQKAQTLDHAMELLRNSVADNQTTLASEDYHDATAQRQNDYNQAVTAANNIINQTTSPTMNPDDVNGATTQVNNTKVALDGDENLAAAKQQANNRLDQLDHLNNAQKQQLQSQITQSSDIAAVNGHKQTAESLNTAMGNLINAIADHQAVEQRGNFINADTDKQTAYNTAVNEAAAMINKQTGQNANQTEVEQAITKVQTTLQALNGDHNLQVAKTNATQAIDALTSLNDPQKTALKDQVTAATLVTAVHQIEQNANTLNQAMHGLRQSIQDNAATKANSKYINEDQPEQQNYDQAVQAANNIINEQTATLDNNAINQAATTVNTTKAALHGDVKLQNDKDHAKQTVSQLAHLNNAQKHMEDTLIDSETTRTAVKQDLTEAQALDQLMDALQQSIADKDATRASSAYVNAEPNKKQSYDEAVQNAESIIAGLNNPTINKGNVSSATQAVISSKNALDGVERLAQDKQTAGNSLNHLDQLTPAQQQALENQINNATTRDKVAEIIAQAQALNEAMKALKESIKDQPQTEASSKFINEDQAQKDAYTQAVQHAKDLINKTTDPTLAKSIIDQATQAVTDAKNNLHGDQKLAQDKQRATETLNNLSNLNTPQRQALENQINNAATRGEVAQKLTEAQALNQAMEALRNSIQDQQQTEAGSKFINEDKPQKDAYQAAVQNAKDLINQTNNPTLDKAQVEQLTQAVNQAKDNLHGDQKLADDKQHAVTDLNQLNGLNNPQRQALESQINNAATRGEVAQKLAEAKALDQAMQALRNSIQDQQQTESGSKFINEDKPQKDAYQAAVQNAKDLINQTGNPTLDKSQVEQLTQAVTTAKDNLHGDQKLARDQQQAVTTVNALPNLNHAQQQALTDAINAAPTRTEVAQHVQTATELDHAMETLKNKVDQVNTDKAQPNYTEASTDKKEAVDQALQAAESITDPTNGSNANKDAVDQVLTKLQEKENELNGNERVAEAKTQAKQTIDQLTHLNADQIATAKQNIDQATKLQPIAELVDQATQLNQSMDQLQQAVNEHANVEQTVDYTQADSDKQNAYKQAIADAENVLKQNANKQQVDQALQNILNAKQALNGDERVALAKTNGKHDIDQLNALNNAQQDGFKGRIDQSNDLNQIQQIVDEAKALNRAMDQLSQEITDNEGRTKGSTNYVNADTQVKQVYDETVDKAKQALDKSTGQNLTAKQVIKLNDAVTAAKKALNGEERLNNRKAEALQRLDQLTHLNNAQRQLAIQQINNAETLNKASRAINRATKLDNAMGSVQQYIDEQHLGVISSTNYINADDNLKANYDNAIANAAHELDKVQGNAIAKAEAEQLKQNIIDAQNALNGDQNLANAKDKANAFVNSLNGLNQQQQDLAHKAINNADTVSDVTDIVNNQIDLNDAMETLKHLVDNEIPNAEQTVNYQNADDNAKTNFDDAKRLANTLLNSDNTNVNDINGAIQAVNDAIHNLNGDQRLQDAKDKAIQSINQALANKLKEIEASNATDQDKLIAKNKAEELANSIINNINKATSNQAVSQVQTAGNHAIEQVHANEIPKAKIDANKDVDKQVQALIDEIDRNPNLTDKEKQALKDRINQILQQGHNGINNAMTKEEIEQAKAQLAQALQDIKDLVKAKEDAKQDVDKQVQALIDEIDQNPNLTDKEKQALKDRINQILQQGHNDINNAMTKEAIEQAKERLAQALQDIKDLVKAKEDAKNDIDKRVQALIDEIDQNPNLTDKEKQALKDRINQILQQGHNDINNALTKEEIEQAKAQLAQALQDIKDLVKAKEDAKNAIKALANAKRDQINSNPDLTPEQKAKALKEIDEAEKRALQNVENAQTIDQLNRGLNLGLDDIRNTHVWEVDEQPAVNEIFEATPEQILVNGELIVHRDDIITEQDILAHINLIDQLSAEVIDTPSTATISDSLTAKVEVTLLDGSKVIVNVPVKVVEKELSVVKQQAIESIENAAQQKINEINNSVTLTLEQKEAAIAEVNKLKQQAIDHVNNAPDVHSVEEIQQQEQAHIEQFNPEQFTIEQAKSNAIKSIEDAIQHMIDEIKARTDLTDKEKQEAIAKLNQLKEQAIQAIQRAQSIDEISEQLEQFKAQMKAANPTAKELAKRKQEAISRIKDFSNEKINSIRNSEIGTADEKQAAMNQINEIVLETIRDINNAHTLQQVEAALNNGIARISAVQIVTSDRAKQSSSTGNESNSHLTIGYGTANHPFNSSTIGHKKKLDEDDDIDPLHMRHFSNNFGNVIKNAIGVVGISGLLASFWFFIAKRRRKEDEEEELEIRDNNKDSIKETLDDTKHLPLLFAKRRRKEDEEDVTVEEKDSLNNGESLDKVKHTPFFLPKRRRKEDEEDVEVTNENTDEKVLKDNEHSPLLFAKRRKDKEEDVETTTSIESKDEDVPLLLAKKKNQKDNQSKDKKSASKNTSKKVAAKKKKKKAKKNKK

SEQ ID NO: 6 - protein, 486 aa, Staphylococcus aureus
MSNNFKDDFEKNRQSIDTNSHQDHTEDVEKDQSELEHQDTIENTEQQFPPRNAQRRKRRRDLATNHNKQVHNESQTSEDNVQNEAGTIDDRQVESSHSTESQEPSHQDSTPQHEEEYYNKNAFAMDKSHPEPIEDNDKHDTIKNAENNTEHSTVSDKSEAEQSQQPKPYFTTGANQSETSKNEHDNDSVKQDQDEPKEHHNGKKAAAIGAGTAGVAGAAGAMAASKAKKHSNDAQNKSNSGKANNSTEDKASQDKSKDHHNGKKGAAIGAGTAGLAGGAASKSASAASKPHASNNASQNHDEHDNHDRDKERKKGGMAKVLLPLIAAVLIIGALAIFGGMALNNHNNGTKENKIANTNKNNADESKDKDTSKDASKDKSKSTDSDKSKEDQDKATKDESDNDQNNANQANNQAQNNQNQQQANQNQQQQQQRQGGGQRHTVNGQENLYRIAIQYYGSGSPENVEKIRRANGLSGNNIRNGQQIVIP

SEQ ID NO: 7 - protein, 165 aa, Staphylococcus aureus
MKNKLIAKSLLTLAAIGITTTTIASTADASEGYGPREKKPVSINHNIVEYNDGTFKYQSRPKFNSTPKYIKFKHDYNILEFNDGTFEYGARPQFNKPAAKTDATIKKEQKLIQAQNLVREFEKTHTVSAHRKAQKAVNLVSFEYKVKKMVLQERIDNVLKQGLVK

SEQ ID NO: 8 - protein, 340 aa, Staphylococcus aureus
MKKKLLVLTMSTLFATQIMNSNHAKASVTESVDKKFVVPESGINKIIPAYDEFKNSPKVNVSNLTDNKNFVASEDKLNKIADSSAASKIVDKNFVVPESKLGNIVPEYKEINNRVNVATNNPASQQVDKHFVAKGPEVNRFITQNKVNHHFITTQTHYKKVITSYKSTHVHKHVNHAKDSINKHFIVKPSESPRYTHPSQSLIIKHHFAVPGYHAHKFVTPGHASIKINHFCVVPQINSFKVIPPYGHNSHRMHVPSFQNNTTATHQNAKVNKAYDYKYFYSYKVVKGVKKYFSFSQSNGYKIGKPSLNIKNVNYQYAVPSYSPTHYVPEFKGSLPAPRV

SEQ ID NO: 9 - protein, 130 aa, Staphylococcus aureus
MNFNDIETMVKSKFKDIKKHAEEIAHEIEVRSGYLRKAEQYKRLEFNLSFALDDIESTAKDVQTAKSSANKDSVTVKGKAPNTLYIEKRNLMKQKLEMLGEDIDKNKESLQKAKEIAGEKASEYFNKAMN

SEQ ID NO: 10 - protein, 97 aa, Staphylococcus aureus
MAMIKMSPEEIRAKSQSYGQGSDQIRQILSDLTRAQGEIAANWEGQAFSRFEEQFQQLSPKVEKFAQLLEEIKQQLNSTADAVQEQDQQLSNNFGLQ

SEQ ID NO: 11 - protein, 104 aa, Staphylococcus aureus
MGGYKGIKADGGKVDQAKQLAAKTAKDIEACQKQTQQLAEYIEGSDWEGQFANKVKDVLLIMAKFQEELVQPMADHQKAIDNLSQNLAKYDTLSIKQGLDRVNP

SEQ ID NO: 12 - protein, 990 aa, Staphylococcus aureus
MGQDKEAAASEQKTTTVEENGNSATDNKTSETQTTATNVNHIEETQSYNATVTEQPSNATQVTTEEAPKAVQAPQTAQPANIETVKEEVVKEEAKPQVKETTQSQDNSGDQRQVDLTPKKATQNQVAETQVEVAQPRTASESKPRVTRSADVAEAKEASNAKVETGTDVTSKVTVEIGSIEGHNNTNKVEPHAGQRAVLKYKLKFENGLHQGDYFDFTLSNNVNTHGVSTARKVPEIKNGSVVMATGEVLEGGKIRYTFTNDIEDKVDVTAELEINLFIDPKTVQTNGNQTITSTLNEEQTSKELDVKYKDGIGNYYANLNGSIETFNKANNRFSHVAFIKPNNGKTTSVTVTGTLMKGSNQNGNQPKVRIFEYLGNNEDIAKSVYANTTDTSKFKEVTSNMSGNLNLQNNGSYSLNIENLDKTYVVHYDGEYLNGTDEVDFRTQMVGHPEQLYKYYYDRGYTLTWDNGLVLYSNKANGNEKNGPIIQNNKFEYKEDTIKETLTGQYDKNLVTTVEEEYDSSTLDIDYHTAIDGGGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTVEDTKEYTTESNLIELVDELPEEHGQAQGPVEEITKNNHHISHSGLGTENGHGNYDVIEEIEENSHVDIKSELGYEGGQNSGNQSFEEDTEEDKPKYEQGGNIVDIDFDSVPQIHGQNKGNQSFEEDTEKDKPKYEHGGNIIDIDFDSVPHIHGFNKHTEIIEEDTNKDKPSYQFGGHNSVDFEEDTLPKVSGQNEGQQTIEEDTTPPIVPPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKKPQSKKSELPETGGEESTNKGMLFGGLFSILGLALLRRNKKNHKA

SEQ ID NO: 13 - protein, 917 aa, Staphylococcus aureus
MIVVGMGQEKEAAASEQNNTTVEESGSSATESKASETQTTTNNVNTIDETQSYSATSTEQPSQSTQVTTEEAPKTVQAPKVETSRVDLPSEKVADKETTGTQVDIAQPSNVSEIKPRMKRSTDVTAVAEKEVVEETKATGTDVTNKVEVEEGSEIVGHKQDTNVVNPHNAERVTLKYKWKFGEGIKAGDYFDFTLSDNVETHGISTLRKVPEIKSTDGQVMATGEIIGERKVRYTFKEYVQEKKDLTAELSLNLFIDPTTVTQKGNQNVEVKLGETTVSKIFNIQYLGGVRDNWGVTANGRIDTLNKVDGKFSHFAYMKPNNQSLSSVTVTGQVTKGNKPGVNNPTVKVYKHIGSDDLAESVYAKLDDVSKFEDVTDNMSLDFDTNGGYSLNFNNLDQSKNYVIKYEGYYDSNASNLEFQTHLFGYYNYYYTSNLTWKNGVAFYSNNAQGDGKDKLKEPIIEHSTPIELEFKSEPPVEKHELTGTIEESNDSKPIDFEYHTAVEGAEGHAEGTIETEEDSIHVDFEESTHENSKHHADVVEYEEDTNPGGGQVTTESNLVEFDEDSTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNNGNQSFEEDTEKDKPKYEQGGNIIDIDFDSVPHIHGFNKHTEIIEEDTNKDKPNYQFGGHNSVDFEEDTLPQVSGHNEGQQTIEEDTTPPIVPPTPPTPEVPSEPETPTPPTPEVPSEPETPTPPTPEVPTEPGKPIPPAKEEPKKPSKPVEQGKVVTPVIEINEKVKAVVPTKKAQSKKSELPETGGEESTNNGMLFGGLFSILGLALLRRNKKNHKA

SEQ ID NO: 14 - protein, 319 aa, Staphylococcus aureus
MKTRIVSSVTTTLLLGSILMNPVANAADSDINIKTGTTDIGSNTTVKTGDLVTYDKENGMHKKVFYSFIDDKNHNKKLLVIRTKGTIAGQYRVYSEEGANKSGLAWPSAFKVQLQLPDNEVAQISDYYPRNSIDTKEYMSTLTYGFNGNVTGDDTGKIGGLIGANVSIGHTLKYVQPDFKTILESPTDKKVGWKVIFNNMVNQNWGPYDRDSWNPVYGNQLFMKTRNGSMKAADNFLDPNKASSLLSSGFSPDFATVITMDRKASKQQTNIDVIYERVRDDYQLHWTSTNWKGTNTKDKWIDRSSERYKIDWEKEEMTN

SEQ ID NO: 15 - protein, 325 aa, Staphylococcus aureus
MKMNKLVKSSVATSMALLLLSGTANAEGKITPVSVKKVDDKVTLYKTTATADSDKFKISQILTFNFIKDKSYDKDTLVLKATGNINSGFVKPNPNDYDFSKLYWGAKYNVSISSQSNDSVNVVDYAPKNQNEEFQVQNTLGYTFGGDISISNGLSGGLNGNTAFSETINYKQESYRTTLSRNTNYKNVGWGVEAHKIMNNGWGPYGRDSFHPTYGNELFLAGRQSSAYAGQNFIAQHQMPLLSRSNFNPEFLSVLSHRQDGAKKSKITVTYQREMDLYQIRWNGFYWAGANYKNFKTRTFKSTYEIDWENHKVKLLDTKETENNK

SEQ ID NO: 16 - protein, 315 aa, Staphylococcus aureus
MLKNKILTTTLSVSLLAPLANPLLENAKAANDTEDIGKGSDIEIIKRTEDKTSNKWGVTQNIQFDFVKDKKYNKDALILKMQGFISSRTTYYNYKKTNHVKAMRWPFQYNIGLKTNDKYVSLINYLPKNKIESTNVSQTLGYNIGGNFQSAPSLGGNGSFNYSKSISYTQQNYVSEVEQQNSKSVLWGVKANSFATESGQKSAFDSDLFVGYKPHSKDPRDYFVPDSELPPLVQSGFNPSFIATVSHEKGSSDTSEFEITYGRNMDVTHAIKRSTHYGNSYLDGHRVHNAFVNRNYTVKYEVNWKTHEIKVKGQN

SEQ ID NO: 17 - protein, 350 aa, Staphylococcus aureus
MTKHYLNSKYQSEQRSSAMKKITMGTASIILGSLVYIGADSQQVNAATEATNATNNQSTQVSQATSQPINFQVQKDGSSEKSHMDDYMQHPGKVIKQNNKYYFQTVLNNASFWKEYKFYNANNQELATTVVNDNKKADTRTINVAVEPGYKSLTTKVHIVVPQINYNHRYTTHLEFEKAIPTLADAAKPNNVKPVQPKPAQPKTPTEQTKPVQPKVEKVKPTVTTTSKVEDNHSTKVVSTDTTKDQTKTQTAHTVKTAQTAQEQNKVQTPVKDVATAKSESNNQAVSDNKSQQTNKVTKHNETPKQASKAKELPKTGLTSVDNFISTVAFATLALLGSLSLLLFKRKESK

SEQ ID NO: 18 - protein, 645 aa, Staphylococcus aureus
MNKQQKEFKSFYSIRKSSLGVASVAISTLLLLMSNGEAQAAAEETGGTNTEAQPKTEAVASPTTTSEKAPETKPVANAVSVSNKEVEAPTSETKEAKEVKEVKAPKETKEVKPAAKATNNTYPILNQELREAIKNPAIKDKDHSAPNSRPIDFEMKKKDGTQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEDTKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANTDKSNKKEQQDNSAKKEATPATPSKPTPSPVEKESQKQDSQKDDNKQLPSVEKENDASSESGKDKTPATKPTKGEVESSSTTPTKVVSTTQNVAKPTTASSKTTKDVVQTSAGSSEAKDSAPLQKANIKNTNDGHTQSQNNKNTQENKAKSLPQTGEESNKDMTLPLMALLALSSIVAFVLPRKRKN

SEQ ID NO: 19 - protein, 227 aa, Staphylococcus aureus
MKNILKVFNTTILALIIIIATFSNSANAADSGTLNYEVYKYNTNDTSIANDYFNKPAKYIKKNGKLYVQITVNHSHWITGMSIEGHKENIISKNTAKDERTSEFEVSKLNGKIDGKIDVYIDEKVNGKPFKYDHHYNITYKFNGPTDVAGANAPGKDDKNSASGSDKGSDGTTTGQSESNSSNKDKVENPQTNAGTPAYIYAIPVASLALLIAITLFVRKKSKGNVE

SEQ ID NO: 20 - protein, 107 aa, Staphylococcus aureus
MKFMAENRLTLTKGTAKDIIERFYTRHGIETLEGFDGMFVTQTLEQEDFDEVKILTVWKSKQAFTDWLKSDVFKAAHKHVRSKNEDESSPIINNKVITYDIGYSYMK

SEQ ID NO: 21 - protein, 895 aa, Staphylococcus aureus
MNKHHPKLRSFYSIRKSTLGVASVIVSTLFLITSQHQAQAAENTNTSDKISENQNNNATTTQPPKDTNQTQPATQPANTAKNYPAADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGEETNYDYTKLVFAKPIYNDPSLVKSDTNDAVVTNDQSSSVASNQTNTNTSNQNISTINNANNQPQATTNMSQPAQPKSSTNADQASSQPAHETNSNGNTNDKTNESSNQSDVNQQYPPADESLQDAIKNPAIIDKEHTADNWRPIDFQMKNDKGERQFYHYASTVEPATVIFTKTGPIIELGLKTASTWKKFEVYEGDKKLPVELVSYDSDKDYAYIRFPVSNGTREVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRTLIFPYIPDKAVYNAIVKVVVANIGYEGQYHVRIINQDINTKDDDTSQNNTSEPLNVQTGQEGKVADTDVAENSSTATNPKDASDKADVIEPESDVVKDADNNIDKDVQHDVDHLSDMSDNNHFDKYDLKEMDTQIAKDTDRNVDKDADNSVGMSSNVDTDKDSNKNKDKVIQLNHIADKNNHTGKAAKLDVVKQNYNNTDKVTDKKTTEHLPSDIHKTVDKTVKTKEKAGTPSKENKLSQSKMLPKTGETTSSQSWWGLYALLGMLALFIPKFRKESK

SEQ ID NO: 22 - protein, 108 aa, Staphylococcus aureus
MFMAENRLQLQKGSAEETIERFYNRQGIETIEGFQQMFVTKTLNTEDTDEVKILTIWESEDSFNNWLNSDVFKEAHKNVRLKSDDDGQQSPILSNKVFKYDIGYHYQK

SEQ ID NO: 23 - protein, 327 aa, Staphylococcus aureus
MKMKKLVKSSVASSIALLLLSNTVDAAQHITPVSEKKVDDKITLYKTTATSDNDKLNISQILTFNFIKDKSYDKDTLVLKAAGNINSGYKKPNPKDYNYSQFYWGGKYNVSVSSESNDAVNVVDYAPKNQNEEFQVQQTLGYSYGGDINISNGLSGGLNGSKSFSETINYKQESYRTTIDRKTNHKSIGWGVEAHKIMNNGWGPYGRDSYDPTYGNELFLGGRQSSSNAGQNFLPTHQMPLLARGNFNPEFISVLSHKQNDTKKSKIKVTYQREMDRYTNQWNRLHWVGNNYKNQNTVTFTSTYEVDWQNHTVKLIGTDSKETNPGV

SEQ ID NO: 24 - protein, 301 aa, Staphylococcus aureus
MSVGLIAPLASPIQESRANTNIENIGDGAEVIKRTEDVSSKKWGVTQNVQFDFVKDKKYNKDALIVKMQGFINSRTSFSDVKGSGYELTKRMIWPFQYNIGLTTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPTGSAREYFAPDNQLPPLVQSGFNPSFITTLSHEKGSSDTSEFEISYGRNLDITYATLFPRTGIYAERKHNAFVNRNFVVRYEVNWKTHEIKVKGHN

SEQ ID NO: 25 - protein, 338 aa, Staphylococcus aureus
MIKQLCKNITICTLALSTTFTVLPATSFAKINSEIKQVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRNGNLWAKDNFTPKDKMPVTVSEGFNPEFLAVMSHDKKDKGKSQFVVHYKRSMDEFKIDWNRHGFWGYWSGENHVDKKEEKLSALYEVDWKTHNVKFVKVLNDNEKK

SEQ ID NO: 26 - protein, 351 aa, Staphylococcus aureus
MKNKKRVLIASSLSCAILLLSAATTQANSAHKDSQDQNKKEHVDKSQQKDKRNVTNKDKNSTAPDDIGKNGKITKRTETVYDEKTNILQNLQFDFIDDPTYDKNVLLVKKQGSIHSNLKFESHKEEKNSNWLKYPSEYHVDFQVKRNRKTEILDQLPKNKISTAKVDSTFSYSSGGKFDSTKGIGRTSSNSYSKTISYNQQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKNKDGQRLIVTYEVDWKNKTVKVVDKYSDDNKPYKEG

SEQ ID NO: 27 - protein, 177 aa, Staphylococcus aureus
MKSNKSLAMIVVAIIIVGVLAFQFMNHTGPFKKGTNHETVQDLNGKDKVHVQRVVDGDTFIANQNGKEIKVRLIGVDTPETVKPNTPVQPFGKEASNYSKKTLTNQDVYLEYDKEKQDRYGRTLAYVWISKDRMYNKELVEKGLAREKYFSPNGKYRNVFIEAQNKAKQQKLNIWSK

SEQ ID NO: 28 - protein, 2271 aa, Staphylococcus aureus
MSKRQKAFHDSLANEKTRVRLYKSGKNWVKSGIKEIEMFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSEKVTSTTNSTSNQQEKLTSTSESTSSKNTTSSSDTKSVASTSSTEQPINTSTNQSTASNNTSQSTTPSSVNLNKTSTTSTSTAPVKLRTFSRLAMSTFASAATTTAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSKPNSAAKANADPSNVAGGGAFGAFVTTDSYGVATTYTSSSTADNAAKLNVQPTNNTFQDFDINYNGDTKVMTVKYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTISIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSDSASKSTSLSDSISNSSSTEKSESLSTSTSDSLRTSTSLSDSLSMSTSGSLSKSQSLSTSISGSSSTSASLSDSTSNAISTSTSLSESASTSDSISISNSIANSQSASTSKSDSQSTSISLSTSDSKSMSTSESLSDSTSTSGSVSGSLSIAASQSVSTSTSDSMSTSEIVSDSISTSGSLSASDSKSMSVSSSMSTSQSGSTSESLSDSQSTSDSDSKSLSQSTSQSGSTSTSTSTSASVRTSESQSTSGSMSASQSDSMSISTSFSDSTSDSKSASTASSESISQSASTSTSGSVSTSTSLSTSNSERTSTSMSDSTSLSTSESDSISESTSTSDSISEAISASESTFISLSESNSTSDSESQSASAFLSESLSESTSESTSESVSSSTSESTSLSDSTSESGSTSTSLSNSTSGSTSISTSTSISESTSTFKSESVSTSLSMSTSTSLSDSTSLSTSLSDSTSDSKSDSLSTSMSTSDSISTSKSDSISTSTSLSGSTSESESDSTSSSESKSDSTSMSISMSQSTSGSTSTSTSTSLSDSTSTSLSLSASMNQSGVDSNSASQSASNSTSTSTSESDSQSTSSYTSQSTSQSESTSTSTSLSDSTSISKSTSQSGSVSTSASLSGSESESDSQSISTSASESTSESASTSLSDSTSTSNSGSASTSTSLNNSASASESDLSSTSLSDSTSASMQSSESDSQSTSASLSDSLSTSTSNRMSTIASLSTSVSTSESGSTSESTSESDSTSTSLSDSQSTSRSTSASGSASTSTSTSDSRSTSASTSTSMRTSTSDSQSMSLSTSTSTSMSDSTSLSDSVSDSTSDSTSASTSGSMSVSISLSDSTSTSTSASEVMSASISDSQSMSESVNDSESVSESNSESDSKSMSGSTSVSDSGSLSVSTSLRKSESVSESSSLSCSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSMSTSDSSSISGSNSTSTSLSTSDSMSGSVSVSTSTSLSDSISGSTSVSDSSSTSTSTSLSDSMSQSQSTSTSASGSLSTSISTSMSMSASTSSSQSTSVSTSLSTSDSISDSTSISISGSQSTVESESTSDSTSISDSESLSTSDSDSTSTSTSDSTSGSTSTSISESLSTSGSGSTSVSDSTSMSESNSSSVSMSQDKSDSTSISDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 29 - protein, 2478 aa, Staphylococcus aureus
MNLFRQQKFSIRKFNVGIFSALIATVTFISTNPTTASAAEQNQPAQNQPAQPADANTQPNANAGAQANPTAQPAAPANQGQPAVQPANQGGQANPAGGAAQPNTQPAGQGDQADPNNAAQAQPGNQATPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNNSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVKTANRASQADIDGLVTKLQAALIDNQAAIAELDTKAQEKVTAAQQSKKVTQDEVAALVTKINNDKNNAIAEINKQTTAQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEISKIENITDSTQTKMDAYNEVKQAATARKAQNATVSNATNEEVAEADAAVDAAQKQGLHDIQVVKSKQEVADTKSKVLDKINAIQTQAKVKPAADTEVENAYNTRKQEIQNSNASTTEEKQAAYTELDTKKQEARTNLDAANTNSDVTTAKDNSIAAINQVQAATTKKSDAKAEIAQKASERKTAIEAMNDSTTEEQQAAKDKVDQAVVTANADIDNAAANNDVDNAKTTNEATIAAITPDANVKPAAKQAIADKVQAQETAIDGNNGSTTEEKAAAKQQVQTEKTTADAAIDAAHTNAEVEAAKKAAIAKIEAIQPATTTKDNAKEAIATKANERKTAIAQTQDITAEEIAAANADVDNAVTQANSNIEAANSQNDVDQAKTTGENSIDQVTPTVNKKATARNEITAILNNKLQEIQATPDATDEEKQAADAEANTENGKANQAISAATTNAQVDEAKANAEAAINAVTPKVVKKQAAKDEIDQLQATQTNVINNDQNATTEEKEAAIQQLATAVTDAKNNITAATDDNGVDQAKDAGKNSIQSTQPATAVKSNAKNDVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALESINNGVDNGDVDDALTQGKAAIDAIQVDATVKPKANQAIEVKAEDTKESIDQSDQLTAEEKTEALAMIKQITDQAKQGITDATTTAEVEKAKAQGLEAFDNIQIDSTEKQKAIEELETALDQIEAGVNVNADATTEEKEAFTNALEDILSKATEDISDQTTNAEIATVKNSALEQLKAQRINPEVKKNALEAIREVVNKQIEIIKNADADASAKEIARTDLGRYFDRFADKLDKTQTNAEVAELQNVTIPAIEAIVPQNDPDANDTNNGIDNNDATANSNANATPENTGQPNVSETTANGKADASPTTPNNSDAATGETTATSATDDANDKPQANNNSSVDASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNDKVAQPKSENKAKAEKDGSDSTNQSMVESTTETLPSADITEPNVPSNTSKDKEESTTNQTDAGQLKSETNVASNEADKSPSKADTEVSNKPSTSASSEAKEKMTSTNVSQKDDTATADTNDTQKSVGSAANNKATQNDGANASPATVSNGSNSANQDMLNVTNTDDHQAKTKSAQQGKVNKAKQQAKTLPDTGMSHNDDLPYAELALGAGMAFLIRRFTKKDQQTEE

SEQ ID NO: 30 - protein, 2186 aa, Staphylococcus aureus
MNLLKKNKYSIRKYKVGIFSTLIGTVLLLSNPNGAQALTTDNNVQSDTNQATPVNSQDKDVANNRGLANSAQNTPNQSATTNQATNQALVNHNNGSIVNQATPTSVQSSTPSAQNNNHTDGNTTATETVSNANNNDVVSNNTALNVPTKTNENGSGGHLTLKEIQEDVRHSSNKPELVAIAEPASNRPKKRSRRAAPADPNATPADPAAAAVGNGGAPVAITAPYTPTTDPNANNAGQNAPNEVLSFDDNGIRPSTNRSVPTVNVVNNLPGFTLINGGKVGVFSHAMVRTSMFDSGDNKNYQAQGNVIALGRIHGTDTNDHGDFNGIEKALTVNPNSELIFEFNTMTTKNGQGATNVIIKNADTNDTIAEKTVEGGPTLRLFKVPDNVRNLKIQFVPKNDAITDARGIYQLKDGYKYYSFVDSIGLHSGSHVFVERRTMDPTATNNKEFTVTTSLKNNGNSGASLDTNDFVYQVQLPEGVEYVNNSLTKDFPSNNSGVDVNDMNVTYDAANRVITIKSTGGGTANSPARLMPDKILDLRYKLRVNNVPTPRTVTFNETLTYKTYTQDFINSAAESHTVSTNPYTIDIIMNKDALQAEVDRRIQQADYTFASLDIFNGLKRRAQTILDENRNNVPLNKRVSQAYIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDATEDEIQDALNQLATDETDAIDNVTNATTNADVETAKNNGINTIGAVVPQVTHKKAARDAINQATATKRQQINSNREATQEEKNAALNELTQATNHALEQINQATTNANVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDTRNVVNDKAREAITNINATTGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAINQINQNQTNDQVDTTTNQAVNAIDNVEAEVVIKTKAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVTPDHIVRAAARDAVKQQYEAKKREIEQAEHATDEEKQVALNQLANNEKRALQNIDQAIANNDVKRVETNGIATLKGVQPHIVIKPEAQQAIKASAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSINAQNIISKIKPATTVKATALQQIQNIATNKINLIKANNEATDEEQNIAIAQVEKELIKAKQQIASAVTNADVAYLLHDEKNEIREIEPVINRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSNRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEATKVSPKEIQPAPKVCTPIKKEETHESRKVEKELPNTGSEGMDLPLKEFALITGAALLARRRTKNEKES

SEQ ID NO: 31 - protein, 199 aa, Staphylococcus aureus
MKKLATVGSLIVTSTLVFSSMPFQNAHADTTSMNVSNKQSQNVQNHRPYGGVVPQGMTQAQYTELEKALPQLSAGSNMQDYNMKLYDATQNIADKYNVIITTNVGVFKPHAVRDMNGHALPLTKDGNFYQTNVDANGVNHGGSEMVQNKTGHMSQQGHMNQNTHEPTATHATRSYAIIKPSNDESKSKYAFIKSSNEPK

SEQ ID NO: 32 - protein, 635 aa, Staphylococcus aureus
MAKYRGKPFQLYVKLSCSTMMATSIILTNILPYDAQAASEKDTEITKEILSKQDLLDKVDKAIRQIEQLKQLSASSKEHYKAQLNEAKTASQIDEIIKRANELDSKDNKSSHTEMNGQSDIDSKLDQLLKDLNEVSSNVDRGQQSGEDDLNAMKNDMSQTATTKHGEKDDKNDEAMVNKALEDLDHLNQQIHKSKDASKDTSEDPAVSTTDNNHEVAKTPNNDGSGHVVLNKFLSNEENQSHSNRLTDKLQGSDKINHAMIEKLAKSNASTQHYTYHKLNTLQSLDQRIANTQLPKNQKSDLMSEVNKTKERIKSQRNIILEELARTDDKKYATQSILESIFNKDEAVKILKDIRVDGKTDQQIADQITRHIDQLSLTTSDDLLTSLIDQSQDKSLLISQILQTKLGKAEADKLAKDWTNKGLSNRQIVDQLKKHFASTGDTSSDDILKAILNNAKDKKQAIETILATRIERQKAKLLADLITKIETDQNKIFNLVKSALNGKADDLLNLQKRLNQTKKDIDYILSPIVNRPSLLDRLNKNGKTTDLNKLANLMNQGSDLLDSIPDIPTPKPEKTLTLGKGNGLLSGLLNADGNVSLPKAGETIKEHWLPISVIVGAMGVLMIWLSRRNKLKNKA

SEQ ID NO: 33 - protein, 995 aa, Staphylococcus aureus
MNNKKTATNRKGMIPNRLNKFSIRKYSVGTASILVGTTLIFGLSGHEAKAAEHTNGELNQSKNETTAPSENKTTKKVDSRQLKDNTQTATADQPKVTMSDSATVKETSSNMQSPQNATANQSTTKTSNVTTNDKSSTTYSNETDKSNLTQAKDVSTTPKTTTIKPRTLNRMAVNTVAAPQQGTNVNDKVHFSNIDIAIDKGHVNQTTGKTEFWATSSDVLKLKANYTIDDSVKEGDTFTFKYGQYFRPGSVRLPSQTQNLYNAQGNIIAKGIYDSTTNTTTYTFTNYVDQYTNVRGSFEQVAFAKRKNATTDKTAYKMEVTLGNDTYSEEIIVDYGNKKAQPLISSTNYINNEDLSRNMTAYVNQPKNTYTKQTFVTNLTGYKFNPNAKNFKIYEVTDQNQFVDSFTPDTSKLKDVTDQFDVIYSNDNKTATVDLMKGQTSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANVGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDNDSDSDSDSDSDSDSDSDSDSDSDSDSDSDSDSDSDSDSDSDSDSDSDSDSDSDSDSDSDSDSDSDNDSDSDSDSDSDAGKHTPAKPMSTVKDQHKTAKALPETGSENNNSNNGTLFGGLFAALGSLLLFGRRKKQNK

SEQ ID NO: 34 - protein, 1349 aa, Staphylococcus aureus
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLSLKSQITVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKDVTDIKIYQVPKGYTLNKGYDVNTKELTDVTNQYLQKITYGDNNSAVIDFGNADSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYCFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 35 - protein, 1166 aa, Staphylococcus aureus
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEPSTSEIQTKPTTPQESTNIENSQPQPTPSKVDNQVTDATNPKEPVNVSKEELKNNPEKLKELVRNDSNTDHSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPTGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTADDKDSNGLTTTGVIKDADNMTLDRGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 36 - protein, 516 aa, Staphylococcus aureus
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDNNKPGKEDNNKPGKEDNNKPGKEDGNKPGKEDNKKPGKEDGNKPGKEDNKKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 37 - protein, 772 aa, Staphylococcus aureus
MKALLLKTSVWLVLLFSVMGLWQVSNAAEQHTPMKAHAVTTIDKATTDKQQVPPTKEAAHHSGKEAATNVSASAQGTADDTNSKVTSNAPSNKPSTVVSTKVNETRDVDTQQASTQKPTHTATFKLSNAKTASLSPRMFAANAPQTTTHKILHTNDIHGRLAEEKGRVIGMAKLKTVKEQEKPDLMLDAGDAFQGLPLSNQSKGEEMAKAMNAVGYDAMAVGNHEFDFGYDQLKKLEGMLDFPMLSTNVYKDGKRAFKPSTIVTKNGIRYGIIGVTTPETKTKTRPEGIKGVEFRDPLQSVTAEMMRIYKDVDTFVVISHLGIDPSTQETWRGDYLVKQLSQNPQLKKRITVIDGHSHTVLQNGQIYNNDALAQTGTALANIGKITFNYRNGEVSNIKPSLINVKDVENVTPNKALAEQINQADQTFRAQTAEVIIPNNTIDFKGERDDVRTRETNLGNAIADAMEAYGVKNFSKKTDFAVTNGGGIRASIAKGKVTRYDLISVLPFGNTIAQIDVKGSDVWTAFEHSLGAPTTQKDGKTVLTANGGLLHISDSIRVYYDINKPSGKRINAIQILNKETGKFENIDLKRVYHVTMNDFTASGGDGYSMFGGPREEGISLDQVLASYLKTANLAKYDTTEPQRMLLGKPAVSEQPAKGQQGSKGSKSGKDTQPIGDDKVMDPAKKPAPGKVVLLLAHRGTVSSGTEGSGRTIEGATVSSKSGKQLARMSVPKGSAHEKQLPKTGTNQSSSPEAMFVLLAGIGLIATVRRRKAS

SEQ ID NO: 38 - protein, 190 aa, Staphylococcus aureus
MKLKSLAVLSMSAVVLTACGNDTPKDETKSTESNTNQDTNTTKDVIALKDVKTSPEDAVKKAEETYKGQKLKGISFENSNGEWAYKVTQQKSGEESEVLVADKNKKVINKKTEKEDTMNENDNFKYSDAIDYKKAIKEGQKEFDGDIKEWSLEKDDGKLVYNIDLKKGNKKQEVTVDAKNGKVLKSEQDH

SEQ ID NO: 39 - protein, 502 aa, Staphylococcus aureus
MRENFKLRKMKVGLVSVAITMLYIMTNGQAEASENQNALISNINVDNQEKQNNVNQAVQPQNNTNETSKVPANFVKLNDIKPGDTSIQGTTLPNQFILLTIDKKDVSSVEDSDSSFVMSDKDGNFKYDLNGRKIVHNQEIEVSSSDPYLGDDEEDEEVEETSTEEVGAEEESTEAKATYTTPRYEKAYEIPKEQLKEKDGHHQVFIEPITEGSGIIKGHTSVKGKVALSINNKFINFETNANGGPNKEEAKSGSEGIWMPIDDKGYFNFDFKTKRFDDLELKKNDEISLTFAPDDEDEALKSLIFKTKVTSLEDIDKAETKYDHTKVEKVKVLKDVKEDLHVDEIYGSLYHTEKGKGILDKEGTKVIKGKTKFANAVVKVDSELGEGQEFPDLQVDEKGEFSFDVDHAGFRLQNGETLNFTVVDPITGELLSGNFVSKNIDIYESPEEKADREFDERMENTPAYHKLHGDKIVGYDTNGFPITWFYPLGEKKVERKAPKLEK

SEQ ID NO: 40 - protein, 342 aa, Staphylococcus aureus
MKKTVLYLVLAVMFLLAACGNNSDKEQSKSETKGSKDTVKIENNYKMRGEKKDGSDAKKVKETVEVPKNPKNAVVLDYGALDVMKEMGLSDKVKALPKGEGGKSLPNFLESFKDDKYTNVGNLKEVNFDKIAATKPEVIFISGRTANQKNLDEFKKAAPKAKIVYVGADEKNLIGSMKQNTENIGKIYDKEDKAKELNKDLDNKIASMKDKTKNFNKTVMYLLVNEGELSTFGPKGRFGGLVYDTLGFNAVDKKVSNSNHGQNVSNEYVNKENPDVILAMDRGQAISGKSTAKQALNNPVLKNVKAIKEDKVYNLDPKLWYFAAGSTTTTIKQIEELDKVVK

SEQ ID NO: 41 - protein, 241 aa, Staphylococcus aureus
MKKNIMNKLVLSTALLLLETTSTQLPKTPISFSSEAKAYNISENETNINELIKYYTQPHFSLSGKWLWQKPNGSIHATLQTWVWYSHIQVFGSESWGNINQLRNKYVDIFGTKDEDTVEGYWTYDETFTGGVTPAATSSDKPYRLFLKYSDKQQTIIGGHEFYKGNKPVLTLKELDFRIRQTLIKNKKLYNGEFNKGQIKITADGNNYTIDLSKKLKLTDTNRYVKNPRNAEIEVILEKSN

SEQ ID NO: 42 - protein, 302 aa, Staphylococcus aureus
MKKLLLPLIIMLLVLAACGNQGEKNNKAETKSYKMDDGKTVDIPKDPKRIAVVAPTYAGGLKKLGANIVAVNQQVDQSKVLKDKFKGVTKIGDGDVEKVAKEKPDLIIVYSTDKDIKKYQKVAPTVVVDYNKHKYLEQQEMLGKIVGKEDKVKAWKKDWEETTAKDGKEIKKAIGQDATVSLFDEFDKKLYTYGDNWGRGGEVLYQAFGLKMQPEQQKLTAKAGWAEVKQEEIEKYAGDYIVSTSEGKPTPGYESTNMWKNLKATKEGHIVKVDAGTYWYNDPYTLDFMRKDLKEKLIKAAK

SEQ ID NO: 43 - protein, 267 aa, Staphylococcus aureus
MKKIATATIATAGFATIAIASGNQAHASEQDNYGYNPNDPTSYSYTYTIDAQGNYHYTWKGNWHPSQLNQDNGYYSYYYYNGYNNYNNYNNGYSYNNYSRYNNYSNNNQSYNYNNYNSYNTNSYRTGGLGASYSTSSNNVQVTTTMAPSSNGRSISSGYTSGRNLYTSGQCTYYVFDRVGGKIGSTWGNASNWANAAARAGYTVNNTPKAGAIMQTTQGAYGHVAYVESVNSNGSVRVSEMNYGYGPGVVTSRTISASQAAGYNFIH

SEQ ID NO: 44 - protein, 209 aa, Staphylococcus aureus
MKRLVTGLLALSLFLAACGQDSDQQKDGNKEKDDKAKTEQQDKKTNDSSKDKKDNKDDSKDVNKDNKDNSANDNQQQSNSNATNNDQNQTNNNQSSNNQANNNQKSSYVAPYYGQNAAPVARQIYPFNGNKNQALQQLPNFQTALNAANNEANKFGSNNKVYNDYSIEEHNGNYKYVFSFKDPNANGKYSIVTVDYTGQAMVTDPNYQQ

SEQ ID NO: 45 - protein, 436 aa, Staphylococcus aureus [sequence omitted]

SEQ ID NO: 46 - protein, 233 aa, Staphylococcus aureus
MKKTIMASSLAVALGVTGYAAGTGHQAHAAEVNVDQAHLVDLAHNHQDQLNAAPIKDGAYDIHFVKDGFQYNFTSNGTTWSWSYEAANGQTAGFSNVAGADYTTSYNQGSNVQSVSYNAQSSNSNVEAVSAPTYHNYSTSTTSSSVRLSNGNTAGATGSSAAQIMAQRTGVSASTWAAIIARESNGQVNAYNPSGASGLFQTMPGWGPTNTVDQQINAAVKAYKAQGLGAWGF

SEQ ID NO: 47 - protein, 256 aa, Staphylococcus aureus
MMKRLNKLVLGIIFLFLVISITAGCGIGKEAEVKKSFEKTLSMYPIKNLEDLYDKEGYRDDQFDKNDKGTWIINSEMVIQPNNEDMVAKGMVLYMNRNTKTTNGYYYVDVTKDEDEGKPHDNEKRYPVKMVDNKIIPTKEIKDEKIKKEIENFKFFVQYGDFKNLKNYKDGDISYNPEVPSYSAKYQLTNDDYNVKQLRKRYDIPTSKAPKLLLKGSGNLKGSSVGYKDIEFTFVEKKEENIYFSDSLDYKKSGDV

SEQ ID NO: 48 - protein, 514 aa, Staphylococcus aureus
MKKIYKSLTVSAIVATVSLSALPQSLAITHESQPTKQQRTVLFDRSHGQTAGAADWVSDGAFSDYADSIQKQGYDVKAIDGHSNITEASLKSSKIFVIPEANIPFKESEQAAIVKYVKQGGNVVFISDHYNADRNLNRIDSSEAMNGYRRGAYEDMSKGMNAEEKSSTAMQGVKSSDWLSTNFGVRFRYNALGDLNTSNIVSSKESFGITEGVKSVSMHAGSTLAITNPEKAKGIVYTPEQLPAKSKWSHAVDQGIYNGGGKAEGPYVAISKVGKGKAAFIGDSSLVEDSSPKYVREDNGEKKKTYDGFKEQDNGKLLNNITAWMSKDNDGKSLKASSLTLDTKTKLLDFERPERSTEPEKEPWSQPPSGYKWYDPTTFKAGSYGSEKGADPQPNTPDDHTPPNQNEKVTFDIPQNVSVNEPFEMTIHLKGFEANQTLENLRVGIYKEGGRQIGQFSSKDNDYNPPGYSTLPTVKADENGNVTIKVNAKVLESMEGSKIRLKLGDKTLITTDFK

SEQ ID NO: 49 - protein, 511 aa, Staphylococcus aureus
MSNIAFYVVSDVHGYIFPTDFTSRNQYQPMGLLLANHVIEQDRRQYDQSFKIDNGDFLQGSPFCNYLIAHSGSSQPLVDFYNRMAFDFGTLGNHEFNYGLPYLKDTLRRLNYPVLCANIYENDSTLTDNGVKYFQVGDQTVGVIGLTTQFIPHWEQPEHIQSLTFHSAFEILQQYLPEMKRHADIIVVCYHGGFEKDLESGTPTEVLTGENEGYAMLEAFSKDIDIFITGHQHRQIAERFKQTAVIQPGTRGTTVGRVVLSTDEYENLSVESCELLPVIDDSTFTIDEDDQHLRKQLEDWLDYEITTLPYDMTINHAFEARVAPHPFTNFMNYALLEKSDADVACTALFDSASGFKQVVTMRDVINNYPFPNTFKVLAVSGAKLKEAIERSAEYFDVKNDEVSVSADFLEPKPQHFNYDIYGGVSYTIHVGRPKGQRVSNMMIQGHAVDLKQTYTICVNNYRAVGGGQYDMYIDAPVVKDIQVEGAQLLIDFLSNNNLMRIPQVVDFKVEK

SEQ ID NO: 50 - protein, 324 aa, Staphylococcus aureus
MKRLSIIVIIGIFIITGCDWQRTSKERSKNAQNQQVIKIGYLPITHSANLMMTKKLLSQYNHPKYKLELVKFNNWPDLMDALNSGRIDGASTLIELAMKSKQKGSNIKAVALGHHEGNVIMGQKGMHLNEFNNNGDDYHFGIPHRYSTHYLLLEELRKQLKIKPGHFSYHEMSPAEMPAALSEHRITGYSVAEPFGALGEKLGKGKTLKHGDDVIPDAYCCVLVLRGELLDQHKDVAQAFVQDYKKSGFKMNDRKQSVDIMTHHFKQSRDVLTQSAAWTSYGDLTIKPSGYQEITTLVKQHHLFNPPAYDDFVEPSLYKEASRS

SEQ ID NO: 51 - protein, 591 aa, Staphylococcus aureus
MKKIISIAIIVLALVLSGCGVPTKSEVAQKSSKVEVKGERPTIHFLGQASYENDMNIVKDQLENAGFNVKMNIQPDYGSYRTQRQAGNYDIQIDDWMTVFGDPNYAMTALFSSTGSNSLLKDKHVDQLLNKASTQNEADVKQTYKQIEDEVVFDKGYMAPLYGSKKNLVYDNKVLDKNSVGLPNSRALIWQQFDYNNSRERDTRPLVMTQQDGEIPTLDPIRSIAPSVYSINMNMYTRLLLLDENDHLTTKGSLSHDYAVNKDNKAFYFLLRDDDYFAKVVNGQARNTGERVSAEDVKFSLDRARDKKSVPNNNTYNMHKHINDIKILKDEDIDQLRKEKDKDDKSIYDKLIKAYNVKSLTTDGQKVNNKDGIYQIVKITTDQSMPREVNYLTHSSAGILSKKFVNQVNQEYPKGYGDSSTIPANSDGKNALYASGAYIMTQKNAYQATFQRNPGFNETEKGSYGPAKIKNITLKFNGDPNNALSELRNHSIDMLADVNQKHFDLIKSDKNLSIIRKNGRKSVFLMLNIKKGIFKTHPNLRQAVVNAIDQDQFIKFYRGDKFKIASPITPLVDTGNEQRQDLEKVEKAINQ

SEQ ID NO: 52 - protein, 668 aa, Staphylococcus aureus
MVINLNDKQTKTSKEGLISVSHPLAAKIGKDVLDQGGNAMDAVIAIQLALNVVEPFASGIGGGGYLLYYEQSTGSITAFDARETAPEHVDKQFYLDDSGEYKSFFDMTTHGKTVAVPAIPKLFDYIHKRYAKLSLEDLINPAIELAIEGHAANWATEKYSRQQHARLTKYHETAQVFTHENQYWREGDWIVQPELGKTFQILREQGFNAFYKGDIAKQLVNVVKACGGTITLEDLAKYDIQIKAPISATFKDYDIYSMGPSSSGGITVIQILKLLEHVDLPSMGPRSVDYLHHLIQAMHLAYSDRAQYLADDNFHEVPVQSLIDDDYLKARSTLIDSNKANIDIEHGVVSDCISHTDVEENHTETTHFCVIDKEGNIASFTTSIGMIYGSGITIPGYGVLLNTTMDGFDVVDGGINEIAPYKRPLSNMAPTIVMYHGKPILTVGAPGAISIIASVAQTLINVLVFGMDIQQAIDEPRIYSSHPNRIEWEPQFSQSTILALIAHGHAMEHKPDAYIGDVHGLQVDPTTYEASGGSDDTREGTVMGGEVLVIRKQPLPYRQMYDSDGFRLYFNDVQLPLLADQVRWMHDKYWVDESVVRIIFPEVSAHIEDLRSYENAGENYIDIAWLARKYAYQVTLKDDGLYLTDDTYTSVKRNTNAYYRYDRDSITR

SEQ ID NO: 53 - protein, 322 aa, Staphylococcus aureus
MKSKIYILLLFLIFLSACANTRHSESDKNVLTVYSPYQSNLIRPILNEFEKQEHVKIEIKHGSTQVLLSNLHNEDFSERGDVFMGGVLSETIDHPEDFVPYQDTSVTQQLEDYRSNNKYVTSFLLMPTVIVVNSDLQGDIKIRGYQDLLQPILKGKIAYSNPNTTTTGYQHMRAIYSMHHRVSDVHQFQNHAMQLSKTSKVIEDVAKGKYYAGLSYEQDARTWKNKGYPVSIVYPIEGTMLNVDGIALVKNAHPHPKRKKLVQYLTSRSVQQRLVAEFDAKSIRKDVSEQSDQSIENLKNIPLIPKSKLPDIPHHKFLEMIQ

SEQ ID NO: 54 - protein, 470 aa, Staphylococcus aureus
MHSSGKDLNISLPLKTKSIAPYETDVPVKIGAAESLFKTNDQGKIEKALVKSYHQPNDTTLDIELKDNIKFQNGQKLTAEKVKSSLENSMKKSDLVKYSLPISSITAKGQKLTIKTNSAYPELVSELANPFMAIYDTDAKSDVNQTPVGTGPYQIKDYKQSRKISLSNFKDYWQGKPKLDHITVTYQEDGNNRVRNLESQKDDLITDVPVNKVQDIENNQNLKVSKESGFRTSLLMYNHTNKKMTKSVREALDHIIDRQGIADHIYQGYAKPATSPFNDKIPYIKEPKLTKQNIEQAKMLLAKDGYTKEHPLKIKLITYDGRPELSKIAQVLQSDAKKANIEIDIKSVDDIEGYLKDRSAWDATMYSFGTIPRGDTGYFFNQAYKKDGAINKGDYNNSNVDDLINQLNHTVDVKERHNISNDIIKLSSRDVPNSYIAYNDQIVAANSKVKNYKVTPEGIYLIDYRTTIER

SEQ ID NO: 55 - protein, 316 aa, Staphylococcus aureus [sequence omitted]

SEQ ID NO: 56 - protein, 507 aa, Staphylococcus aureus
MSKKLKIIIPIIIVLLLIGGIAWGVYAFFANTPKNTYLKSEQQTAKMYKDYFNDRFENEVKFQEKMKDNSFLSSLELSADASDEIVKGLGIPKSVVNASKIKMSYGHDPKKEKSMINLEPTIADSALGKFQLAADKDKHYFESPLFKGKYSVNNSDLLSTYSKLTGEDEETAKENGITNQQLNLNTLFNNAQAQQSDYSKIAEKYSELIVDKLDDDNFDKGKKEEIKVNGEKYKVRPVTLTLSRADTKKITLAVLEEAKKDKDLKKLMEEQGATKDFEKDIKKAIDDVKETKKDEFAKIQSKIYTEKHTIVKREITITDKENNKTKIKGTNTLEDDKLKLDYALDFDQDKYTYAEAKYTIKGVSSKEKDNKYNDKYEFGKKTEYDESKIKLDNQEKVDGTKRQDKGKITVALDKYSDENEFTFENNIDSDVKNNTQKSTLNIGIKYAEEPINFILKSSTKLKADIDFDDSGAKDFNSLSSKDREKLEKEIEKNGGKMFESILKKASK

SEQ ID NO: 57 - protein, 297 aa, Staphylococcus aureus
MKKTILLTMTTLTLFSMSPNSAQAYTNDSKTLEEAKKAHPNAQFKVNKDTGAYTYTYDKNNTPNNNHQNQSRTNDNHQHANQRDLNNNQYHSSLSGQYTHINDAIDSHTPPQTSPSNPLTPAIPNVEDNDDELNNAFSKDNKGLITGIDLDELYDELQIAEFNDKAKTADGKPLALGNGKIIDQPLITSKNNLYTAGQCTWYVFDKRAKDGHTISTFWGDAKNWAGQASSNGFKVDRHPTRGSILQTVNGPFGHVAYVEKVNIDGSILISEMNWIGEYIVSSRTISASEVSSYNYIH

SEQ ID NO: 58 - protein, 124 aa, Staphylococcus aureus
MKRILVVFLMLAIILAGCSNKGEKYQKDIDKVYKEQNQMNKIASKVQNTIKTDIKQEDSNTHVYKDGKVIVIGIQLYKDREKMYYFAYEIKDGKAEINREIDPIKYMKDHKADYEDENVEVEKD

SEQ ID NO: 59 - protein, 296 aa, Staphylococcus aureus
MNKISKYIAIASLSVAVTVSAPQTTNSTAFAKSSAEVQQTQQASIPASQKANLGNQNIMAVAWYQNSAEAKALYLQGYNSAKTQLDKEIKKNKGKHKLAIALDLDETVLDNSPYQGYASIHNKPFPEGWHEWVQAAKAKPVYGAKEFLKYADKKGVDIYYISDRDKEKDLKATQKNLKQQGIPQAKKSHILLKGKDDKSKESRRQMVQKDHKLVMLFGDNLLDFTDPKEATAESREALIEKHKDDFGKKYIIFPNPMYGSWEATIYNNNYKASDKAKDKLRKNAIKQFDPKTGEVK

SEQ ID NO: 60 - protein, 690 aa, Staphylococcus aureus
MLRGQEERKYSIRKYSIGVVSVLAATMFVVSSHEAQASEKTSTNAAAQKETLNQPGEQGNAITSHQMQSGKQLDDMHKENGKSGTVTEGKDTLQSSKHQSTQNSKTIRTQNDNQVKQDSERQGSKQSHQNNATNNTERQNDQVQNTHHAERNGSQSTTSQSNDVDKSQPSIPAQKVIPNHDKAAPTSTTPPSNDKTAPKSTKAQDATTDKHPNQQDTHQPAHQIIDAKQDDTVRQSEQKPQVGDLSKHIDGQNSPEKPTDKNTDNKQLIKDALQAPKTRSTTNAAADAKKVRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMATTSRIIGHDAREEWRKNDGVVPVISSLHPSNQPFVNVTNDEPATRRGIWQVKPIIQGWDHVDFIGVDFLDFKRKGAELANFYTGIINDLLRVEATESKGTQLKAS

SEQ ID NO: 61 - protein, 208 aa, Staphylococcus aureus
MKKRLLLSTFLASTLILTGCASDQSDNEDHHTSTGIHAPKSAKKLETKDIFNSDKKNSDISDAEMKQAIEKYLSVNSDILDNKYIMQHKLDKQIDSQTKVTEKQAETLSHLSNLAVKNDLHFKKFVTENNIPKEYKKPVELMMNYFKALNSTIANVDEDIEKLSYQPQNKINVVDVPTKYAGDVNKKQQDKIKDFLKSKGIKSDVIDK

SEQ ID NO: 62 - protein, 261 aa, Staphylococcus aureus
MKSIKRIGLCISLLILIIFVTSCDGDNKIIGDSKEEQIKKSFAKTLDIYPIKNLEDLYDKEGYRDGEFKKDDKGTWLIRSEMKIQLKGENLESRGAVLEINRNTRTAKGHYIVREVVEDSDGMTHNHTKRYPVKMENNKMIPLKPIDDEKVKKEIEEFNFFVQYGNFKELENYKEDEVSYNPEVPIYSAKYQLKNSDYNVEQLRKRYNIPTQKAPKLLLKGSGNLKGSSVGYKNIEFTFIENKEENIYFTDSIYFNPSEDK

SEQ ID NO: 63 - protein, 347 aa, Staphylococcus aureus
MNKDNKWTMITALFITVISVLLAFHLKQHYDQITNENHANKDKINIKNKNVRIYQNLTYNRVFPNSKLDIITPVDMSSNAKLPVIFWMHGGGYIAGDKQYKNPLLAKIAEQGYIVVNVNYALAPQYKYPTPLIQMNQATQFIKENKMNLPIDFNQVIIGGDSAGAQLASQFTAIQTNDRLREAMKFDQSFKPSQIKGAILFGGFYNMQTVRETEFPRIQLFMKSYTGEEDWEKSFKNISQMSTVKQSTKNYPPTFLSVGDSDPFESQNIEFSKKLQELNVPVDTLFYDGTHHLHHQYQFHLNKPESIDNIKKVLLFLSRNTSSSGIQTEEKPQIENPSNELPLNPLN

SEQ ID NO: 64 - protein, 265 aa, Staphylococcus aureus
MKKLAFAITATSGAAAFLTHHDAQASTQHTVQSGESLWSIAQKYNTSVESIKQNNQLDNNLVFPGQVISVGGSDAQNTSNTSPQAGSASSHTVQAGESLNIIASRYGVSVDQLMAANNLRGYLIMPNQTLQIPNGGSGGTTPTATTGSNGNASSFNHQNLYTAGQCTWYVFDRRAQAGSPISTYWSDAKYWAGNAANDGYQVNNTPSVGSIMQSTPGPYGHVAYVERVNGDGSILISEMNYTYGPYNMNYRTIPASEVSSYAFIH

SEQ ID NO: 65 - protein, 292 aa, Staphylococcus aureus
MKKIVIIAVLAILFVVISACGNKEKEAQHQFTKQFKDVEQKQKELQHVMDNIHLKEIDHLSKTDTTDKNSKEFKALQEDVKNHLIPKFEAYYKSAKNLPDDTMKVKKLKKEYMTLANEKKDAIYQLKKFIGLCNQSIKYNEDILDYTKQFEKNRYKVESEIKLADNKSEATNLTTKLEHNNKALRDTAKKNLDDSKENEVKGAIKNHIMPMIEKQITDINQTNISDKHVNNARKNAIEMYYSLQNYYNTRIETIKVSEKLSKVDVDKLPKKGIDITHGDKAFEKKLEKLEEK

SEQ ID NO: 66 - protein, 242 aa, Staphylococcus aureus
MKKVMGILLASTLILGACGHHQDSAKKESTSHKKKENDNEELNEELKEFKSKKNMDIKIKGDTIVSDKFEAKIKEPFIINEKDEKKKYIAFKMEITAKKDDKDLNPSSISHDYINITQDDKNTVNKLRDGYLLSDKKYKDWTEHNQDQIKKGKTAQAMFIYELRGDGNINLNVHKYSEDKTVDSKSFKFSKLKTEDFSHRAETREEVEKKEKEFEEEYKKEQEREKEKEKQKDDDHSGLDEV

SEQ ID NO: 67 - protein, 439 aa, Staphylococcus aureus
MRLTIYHTNDIHSHLHEYERIKAYMAEHRPRLNHPSLYVDLGDHVDLSAPITEATLGKKNVALLNEAKCDVATIGNNEGMTISYEALNHLYDEAKFIVTCSNVIDESGHLPNNIVSSYIKDIDGVKILFVAATAPFTPFYRALNWIVTDPLESIKEEIELQRGKFDVLIVLSHCGIFFDETLCQELPEIDVIFGSHTHHYFEHGEINNGVLMAAAGKYGNYLGEVNLTFEAHKVVHKTAKIIPLETLPEVETSFEEEGKTLMSNSVIQHPVVLKRSMNHITEAAYLLAQSVCEYTHAQCAIINAGLLVKDIVKDEVTEYDIHQMLPHPINMVRVRLFGVKLKEIIAKSNKQEYMYEHAQGLGFRGNIFGGYILYNLGYIHSTGRYYLNGEEIEDDKEYVLGTIDMYTFGRYFPTLKELPKEYLMPEFLRDIFKEKLLEY

SEQ ID NO: 68 - protein, 774 aa, Staphylococcus aureus
MEWTLVDIGKKHVIPKSQYRRKRREFFHNEDREENLNQHQDKQNIDNTTSKKADKQIHKDSIDKHERFKNSLSSHLEQRNRDVNENKAEESKSNQDSKSAYNRDHYLTDDVSKKQNSLDSVDQDTEKSKYYEQNSEATLSTKSTDKVESTEMRKLSSDKNKVGHEEQHVLSKPSEHDKETRIDSESSRTDSDSSMQTEKIKKDSSDGNKSSNLKSEVISDKSNTVPKLSESDDEVNNQKPLTLPEEQKLKRQQSQNEQTKTYTYGDSEQNDKSNHENDLSHHIPSISDDKDNVMRENHIVDDNPDNDINTPSLSKTDDDRKLDEKIHVEDKHKQNADSSETVGYQSQSTASHRSTEKRNISINDHDKLNGQKTNTKTSANNNQKKATSKLNKGRATNNNYSDILKKFWMMYWPKLVILMGIIILIVILNAIFNNVNKNDRMNDNNDADAQKYTTTMKNANNTVKSVVTVENETSKDSSLPKDKASQDEVGSGVVYKKSGDTLYIVTNAHVVGDKENQKITFSNNKSVVGKVLGKDKWSDLAVVKATSSDSSVKEIAIGDSNNLVLGEPILVVGNPLGVDFKGTVTEGIISGLNRNVPIDFDKDNKYDMLMKAFQIDASVNPGNSGGAVVNREGKLIGVVAAKISMPNVENMSFAIPVNEVQKIVKDLETKGKIDYPDVGVKMKNIVSLNSFERQAVKLPGKVKNGVVVDQVDNNGLADQSGLKKGDVITELDGKLLEDDLRFRQIIFSHKDDLKSITAKIYRDGKEKEINIKLK

SEQ ID NO: 69 - protein, 393 aa, Staphylococcus aureus
MNSSCKSRVFNIISIIMVSMLILSLGAFANNNKAKADSHSKQLEINVKSDKVPQKVKDLAQQQFAGYAKALDKQSNAKTGKYELGEAFKIYKFNGEEDNSYYYPVIKDGKIVYTLTLSPKNKDDLNKSKEDMNYSVKISNFIAKDLDQIKDKNSNITVLTDEKGFYFEEDGKVRLVKATPLPGNVKEKESAKTVSAKLKQELKNTVTPTKVEENEAIQEDQVQYENTLKNFKIREQQFDNSWCAGFSMAALLNATKNTDTYNAHDIMRTLYPEVSEQDLPNCATFPNQMIEYGKSQGRDIHYQEGVPSYEQVDQLTKDNVGIMILAQSVSQNPNDPHLGHALAVVGNAKINDQEKLIYWNPWDTELSIQDADSSLLHLSFNRDYNWYGSMIGY

SEQ ID NO: 70 - protein, 336 aa, Staphylococcus aureus
MKGKFLKVSSLFVATLTTATLVSSPAANALSSKAMDNHPQQTQSSKQQTPKIQKGGNLKPLEQREHANVILPNNDRHQITDTTNGHYAPVTYIQVEAPTGTFIASGVVVGKDTLLTNKHVVDATHGDPHALKAFPSAINQDNYPNGGFTAEQITKYSGEGDLAIVKFSPNEQNKHIGEVVKPATMSNNAETQVNQNITVTGYPGDKPVATMWESKGKITYLKGEAMQYDLSTTGGNSGSPVFNEKNEVIGIHWGGVPNEFNGAVFINENVRNFLKQNIEDIHFANDDQPNNPDNPDNPNNPDNPNNPDEPNNPDNPNNPDNPDNGDNNNSDNPDAA

SEQ ID NO: 71 - protein, 397 aa, Staphylococcus aureus
MKFNKVKLVIHACVLLFIIISIALIFHRLQTKTHSIDPIHKETKLSDNEKYLVDRNKEKVAPSKLKEVYNSKDPKYKKIDKYLQSSLFNGSVAIYENGKLKMSKGYGYQDFEKGIKNTPNTMFLIGSAQKFSTGLLLKQLEEEHKININDPVSKYLPWFKTSKPIPLKDLMLHQSGLYKYKSSKDYKNLDQAVKAIQKRGIDPKKYKKHMYNDGNYLVLAKVIEEVTGKSYAENYYTKIGDPLKLQHTAFYDEQPFKKYLAKGYAYNSTGLSFLRPNILDQYYGAGNLYMTPTDMGKLITQIQQYKLFSPKITNPLLHEFGTKKYPDEYRYGFYAKPTLNRLNGGFFGQVFTVYYNDKYVVVLALNVKGNNEVRIKHIYNDILKQNKPYNTKGVIVQ

SEQ ID NO: 72 - protein, 358 aa, Staphylococcus aureus
MRNVKQIATKSIIAIISLGILTYTTMIGSVLADEIKYPSAKFNQPEAKDKTELTTSIFDEKIKENKALELLIFNQENKNVTEEQQLVDEKAQLISDMTGKIYLQVKLKGQIDKEQLVFQNDKNEEFPFVIKDEKDDTIVRILIEQHMDKINMHVKTLAEKKNLDNKEMVYSIHFKEKKVQHDDAKEVPSKHQNQENNQDQLKKDIDDKKDSQKSDTKERRTSLFTEKGLNDIPVQKDKVQQDSNKKIENERPKASGTLKVENSPPTIKKVENNHKEQPKHKDEKSKKEKKKVVEKEKALPAFNRDDDSKNSSQLSSDIKELDEPNHKKQYMLFAAGIVLATILLISAHLYSRKRGNQV

SEQ ID NO: 73 - protein, 282 aa, Staphylococcus aureus
MISVVILTSCQSSSSQESTKSGEFRIVPTTVALTMTLDKLDLPIVGKPTSYKTLPNRYKDVPEIGQPMEPNVEAVKKLKPTHVLSVSTIKDEMQPFYKQLNMKGYFYDFDSLKGMQKSITQLGDQFNRKAQAKELNDHLNSVKQKIENKAAKQKKHPKVLILMGVPGSYLVATDKSYIGDLVKIAGGENVIKVKDRQYISSNTENLLNINPDIILRLPHGMPEEVKKMFQKEFKQNDIWKHFKAVKNNHVYDLEEVPFGITANVDADKAMTQLYDLFYKDKK

SEQ ID NO: 74 - protein, 244 aa, Staphylococcus aureus
MRMKRFLTIVQILLVVIIIIFGYKIVQTYIEDKQERANYEKLQQKFQMLMSKHQEHVRPQFESLEKINKDIVGWIKLSGTSLNYPVLQGKTNHDYLNLDFEREHRRKGSIFMDFRNELKNLNHNTILYGHHVGDNTMFDVLEDYLKQSFYEKHKIIEFDNKYGKYQLQVFSAYKTTTKDNYIRTDFENDQDYQQFLDETKRKSVINSDVNVTVKDRIMTLSTCEDAYSETTKRIVVVAKIIKVS

SEQ ID NO: 75 - protein, 238 aa, Staphylococcus aureus
MSKNITKNIILTTTLLLLGTVLPQNQKPVFSFYSEAKAYSIGQDETNINELIKYYTQPHFSFSNKWLYQYDNGNIYVELKRYSWSAHISLWGAESWGNINQLKDRYVDVFGLKDKDTDQLWWSYRETFTGGVTPAAKPSDKTYNLFVQYKDKLQTIIGAHKIYQGNKPVLTLKEIDFRAREALIKNKILYNENRNKGKLKITGGGNNYTIDLSKRLHSDLANVYVKNPNKITVDVLFD

SEQ ID NO: 76 - protein, 241 aa, Staphylococcus aureus
MNNNITKKIILSTTLLLLGTASTQFPNTPINSSSEAKAYYINQNETNVNELTKYYSQKYLTFSNSTLWQKDNGTIHATLLQFSWYSHIQVYGPESWGNINQLRNKSVDIFGIKDQETIDSFALSQETFTGGVTPAATSNDKHYKLNVTYKDKAETFTGGFPVYEGNKPVLTLKELDFRIRQTLIKSKKLYNNSYNKGQIKITGADNNYTIDLSKRLPSTDANRYVKKPQNAKIEVILEKSN

SEQ ID NO: 77 - protein, 565 aa, Staphylococcus aureus
MAYDGLFTKKMVESLQFLTTGRVHKINQPDNDTILMVVRQNRQNHQLLLSIHPNFSRLQLTTKKYDNPFNPPMFARVFRKHLEGGIIESIKQIGNDRRIEIDIKSKDEIGDTIYRTVILEIMGKHSNLILVDENRKIIEGFKHLTPNTNHYRTVMPGFNYEAPPTQHKINPYDITGAEVLKYIDFNAGNIAKQLLNQFEGFSPLITNEIVSRRQFMTSSTLPEAFDEVMAETKLPPTPIFHKNHETGKEDFYFIKLNQFNDDTVTYDSLNDLLDRFYDARGERERVKQRANDLVRFVQQQLHKYQNKLAKLIEEYEQSKNKDTEQLYGELITANIYRIKQGDKEVTALNYYTNEEVVIPLNPTKSPSANAQYYYKQYNRMKTRERELQHQIQLTKDNIDYFSTIEQQLHHISVHDIDEIRDELAEQGFMKQRKNQTKKKKAQIQLQHYVSTDGDDIYVGKNNKQNDYLTNKKAKKTHTWLHTKDIPGSHVVIFNDAPSDTTIKEAAMLAGYFSKAGNSGQIPVDYTLIKNVHKPSGAKPGFVTYDNQKTLYATPDYELIQKMKQS

SEQ ID NO: 78 - protein, 317 aa, Staphylococcus aureus
MKKTLGCLLLIMLLVVAGCSFGGNHKLSSKKSEESKQETVKKESEEEKDPDLEKYEEIEKKMKGIKDAPSLDKLDPLMTEKSFTNSKGIQGWKDYKELMGKVELADYRFTKDSKGSSIKDVDAFFKGKKGIKRKVIETHDDVKQVDYWYVDPDGKKIGNSNTPVFYAEIMTKYKDGKLVYASVEPGSYVIHKDDAIKYDDYSKLKKLSQLTKLDHPKPVPYSVAQIKSFGVPLTSVSFMTHGSKDTKDEVLPALAYFTFSPKNYEDKSNPDPKVLNLVHMDFLNASSDFGNAHFVVLSKYIKEYESNYETASDDSLK

SEQ ID NO: 79 - protein, 372 aa, Staphylococcus aureus
MNKQQSKVRYSIRKVSIGILSISIGMFLALGMSNKAYADEIDKSKDFTRGYEQNVFAKSELNANKNTTKDKIKNEGAVKTSDTSLKLDNKSAISNGNEINQDIKISNTPKNSSQGNNLVINNNELTKEIKIANLEAQNSNQKKTNKVTNNYFGYYSFREAPKTQIYTVKKGDTLSAIALKYKTTVSNIQNTNNIANPNLIFIGQKLKVPMTPLVEPKPKTVSSNNKSNSNSSTLNYLKTLENRGWDFDGSYGWQCFDLVNVYWNHLYGHGLKGYGAKDIPYANNFNSEAKIYHNTPTFKAEPGDLVVFSGRFGGGYGHTAIVLNGDYDGKLMKFQSLDQNWNNGGWRKAEVAHKVVHNYENDMIFIRPFKKA

SEQ ID NO: 80 - protein, 304 aa, Staphylococcus aureus
MLKKAKFILMATILLSGCSTTNNESNKETKSVPEEMDASKYVGQGFQPPAEKDAIEFAKKHKDKIAKRGEQFFMDNFGLKVKATNVIGSGDGVEVFVHCDDHDIVFNASIPFDKSIIDSDSSLRSKDKGDDMSTLVGAVLSGFEYRAQKEKYDKLYKFFKDNEEKYQYTGFTKEAINKTQNSGYENEYFYISAIPYNLAEYRDYFEPLLNKSDSEFSKELSNVKKQLKDKSKVSVTTTLFSKKKNYTKKSNSENVIKMAEEIKKDKEIPNGIELSIKFSDNKINTVKPNFNGESTSEYGVFDQE

SEQ ID NO: 81 - protein, 193 aa, Staphylococcus aureus
MKKLVSIVGATLLLAGCGSQNLAPLEEKTTDLREDNHQLKLDIQELNQQISDSKSKIKGLEKDKENSKKTASNNTKIKLMNVTSTYYDKVAKALKSYNDIEKDVSKNKGDKNVQSKLNQISNDIQSAHTSYKDAIDGLSLSDDDKKTSKNIDKLNSDLNHAFDDIKNGYQNKDKKQLTKGQQALSKLNLNAKS

SEQ ID NO: 82 - protein, 216 aa, Staphylococcus aureus
MKITYKYRGDLPLNTENNKNQNQSVKNSERRGMLKGCGGCLISFILLIILLSACSMMFSNNDNSTNNQSSKTQLTQKDENKNEDKPEEKSETATDEDLQSTEEVPANENTENNQHEIDEITTKDQSDDDINTPNVAEDKSQDDLKDDLKEKQQSSNHHQSTQPKTSPSTETNTQQSFANCKQLRQVYPNGVTADHPAYRPHLDRDKDKRACEPDKY

SEQ ID NO: 83 - protein, 208 aa, Staphylococcus aureus
MKFKAIVAITLSLSLLTACGANQHKENSSKSNDTNKKTQQTDNTTQSNTEKQMTPQEAEDIVRNDYKARGVNEYQTLNYKTNLERSNEHEYYVEHLVRDAVGTPLKRCAIVNRHNGTIINIFDDMSEKDKEEFEAFKKRSPKYNPGMNNHDETDGESEDIQHHDIDNNKAIQNDIPDQKVDDKNDKNAVNKEEKHDNGANNSEETKVK

SEQ ID NO: 84 - protein, 457 aa, Staphylococcus aureus
MKIIKRAIISLIILSLLISITMSNASASEELYYSVEYKNTATFNKLVKKKSLNVVYNIPELHVAQIKMTKMHANALANYKNDIKYINATCSTCITSEKTIDRTSNESLFSRQWDMNKITNNGASYDDLPKHANTKIAIIDTGVMKNHDDLKNNFSTDSKNLVPLNGFRGTEPEETGDVHDVNDRKGHGTMVSGQTSANGKLIGVAPNNKFTMYRVFGSKKTELLWVSKAIVQAANDGNQVINISVGSYIILDKNDHQTFRKDEKVEYDALQKAINYAKKKKSIVVAAAGNDGIDVNDKQKLKLQREYQGNGEVKDVPASMDNVVTVGSTDQKSNLSEFSNFGMNYTDIAAPGGSFAYLNQFGVDKWMNEGYMHKENILTTANNGRYIYQAGTSLATPKVSGALALIIDKYHLEKHPDKAIELLYQHGTSKNNKPFSRYGHGELDVYKALNVANQKAS

SEQ ID NO: 85 - protein, 320 aa, Staphylococcus aureus
MKMINKLIVPVTASALLLGACGASATDSKENTLISSKAGDVTVADTMKKIGKDQIANASFTEMLNKILADKYKNKVNDKKIDEQIEKMQKQYGGKDKFEKALQQQGLTADKYKENLRTAAYHKELLSDKIKISDSEIKEDSKKASHILIKVKSKKSDKEGLDDKEAKQKAEEIQKEVSKDPSKFGEIAKKESMDTGSAKKDGELGYVLKGQTDKDFEKALFKLKDGEVSEVVKSSFGYHIIKADKPTDFNSEKQSLKEKLVDQKVQKNPKLLTDAYKDLLKEYDVDFKDRDIKSVVEDKILNPEKLKQGGAQGGQSGMSQ

SEQ ID NO: 86 - protein, 388 aa, Staphylococcus aureus
MKRNFPKLIALSLIFSLSVTPIANAESNSNIKAKDKKHVQVNVEDKSVPTDVRNLAQKDYLSYVTSLDKIYNKEKASYTLGEPFKIYKFNKKSDGNYYFPVLNTEGNIDYIVTISPKITKYSSSSSKYTINVSPFLSKVLNQYKDQQITILTNSKGYYVVTQNHKAKLVLKTPRLEDKKLKKTESIPTGNNVTQLKQKASVTMPTSQFKSNNYTYNEQYINKLENFKIRETQGNNGWCAGYTMSELLNATYNTNKYHAEAVMRFLHPNLQGQRFQFTGLTPREMIYFGQTQGRSPQLLNRMTTYNEVDNLTKNNKGIAVLGSRVESRNGMHAGHAMAVVGNAKLDNGQEVIIIWNPWDNGFMTQDAKNNVIPVSNGDHYRWYSSIYGY

SEQ ID NO: 87 - protein, 280 aa, Staphylococcus aureus
MKKFFFIGLLVFVVFFTAATIIWFSYDKNKYGTKQYDKTFKDDAFDNVSINLDSTELRIKRGNQFRVKYDGDNDILINIVDKTLKISDKRSKTRGYAIDMNPFHENKKTLTIEMPDKMIKRLNLSSGAGSVRISDVDLENTSIQSINGEVVIKNSNLDALDSKTNNSSTYISKSNIKNSNIKVVIGTLQIDKSQIKQSIFLNDHGDIEFKNMPSKVDAKASTKQGDIRFKYDSKPEDTILKLNPGTGDSVVKNKTFTNGKVGKSDNVLEFYTIDGNIKVE

SEQ ID NO: 88 - protein, 303 aa, Staphylococcus aureus
MKRLIGILLCNLFILTACSASVDKTSNSTKTTDYKIENGETLKVPEKPKRVAVLTGFYVGDFIKLGIKPIAVSDITKDSSILKPYLKGVDYIGENDVERVAKAKPDLIVVDAMDKNIKKYQKIAPTIPYTYNKYNHKEILKEIGKLTNNEDKAKKWIEEWDDKTRKDKKEIQSKIGQATASVFEPDEKQIYIYNSTWGRGLDIVHDAFGMPMTKQYKDKLQEDKKGYASISKENISKYAGDYIFLSKPSYGKFDFEKTHTWQNIEAVKKGHVISYKAEDYWFTDPITLEHLRSKLKKEILNKK

SEQ ID NO: 89 - protein, 419 aa, Staphylococcus aureus
MSYHWFKKMLLSTSILILSSSSLGLATHTVEAKDNLNGEKPTTNLNHNITSPSVNSEMNNNETGTPHESNQTGNEGTGSNSRDANPDSNNVKPDSNNQNPSTDSKPDPNNQNSSPNPKPDPDNPKPKPDPKPDPDKPKPNPDPKPDPDNPKPNPDPKPDPDKPKPNPDPKPDPDKPKPNPNPKPDPNKPNPNPSPDPDQPGDSNHSGGSKNGGTWNPNASDGSNQGQWQPNGNQGNSQNPTGNDFVSQRFLALANGAYKYNPYILNQINKLGKDYGEVTDEDIYNIIRKQNFSGNAYLNGLQQQSNYFRFQYFNPLKSERYYRNLDEQVLALITGEIGSMPDLKKPEDKPDSKQRSFEPHEKDDFTVVKKQEDNKKSASTAYSKSWLAIVCSMMVVFSIMLFLFVKRNKKKNKNESQRR

SEQ ID NO: 90 - protein, 231 aa, Staphylococcus aureus
MKKTLLASSLAVGLGIVAGNAGHEAHASEADLNKASLAQMAQSNDQTLNQKPIEAGAYNYTFDYEGFTYHFESDGTHFAWNYHATGTNGADMSAQAPATNNVAPSAVQANQVQSQEVEAPQNAQTQQPQASTSNNSQVTATPTESKSSEGSSVNVNAHLKQIAQRESGGNIHAVNPTSGAAGKYQFLQSTWDSVAPAKYKGVSPANAPESVQDAAAVKLYNTGGAGHWVTA

SEQ ID NO: 91 - protein, 294 aa, Staphylococcus aureus
MGVKSVKKIFVIITTLLAVAIIIGSIIMVVFSQRQAQTFKIQQQQFVKKPIPTLFLHGFGGSANSEKFMVKQAEKRGVTKDIITAYVSKDGAVTFKGKLRKDAVNPIVKIELENNRQGYLDKNAAWFKNVLTKLQSEYNFDKFNFVGHSMGNLTFAQYMMTYGNDKSLPQLNKQVNIAGTFNGVLNMNEDVNEITVDKDGKPSRMNQPYQQLRVLKDIYKGKGIEVLNIYGDLKDGTHSDGRVSNSSSKSLKYLLGNSPKSYRESKYEGEPAQHSQLHENENVANELIDFLWKK

SEQ ID NO: 92 - protein, 807 aa, Staphylococcus aureus
MTYRIKKWQKLSTITLLMAGVITLNGGEFRSVDKHQIAVADTNVQTPDYEKLRNTWLDVNYGYDKYDENNPDMKKKFDATEKEATNLLKEMKTESGRKYLWSGAETLETNSSHMTRTYRNIEKIAEAMRNPKTTLNTDENKKKVKDALEWLHKNAYGKEPDKKVKELSENFTKTTGKNTNLNWWDYEIGTPKSLTNTLILLNDQFSNEEKKKFTAPIKTFAPDSDKILSSVGKAELAKGGNLVDISKVKLLECIIEEDKDMMKKSIDSFNKVFTYVQDSATGKERNGFYKDGSYIDHQDVPYTGAYGVVLLEGISQMMPMIKETPFNDKTQNDTTLKSWIDDGFMPLIYKGEMMDLSRGRAISRENETSHSASATVMKSLLRLSDAMDDSTKAKYKKIVKSSVESDSSYKQNDYLNSYSDIDKMKSLMTDNSISKNGLTQQLKIYNDMDRVTYHNKDLDFAFGLSMTSKNVARYESINGENLKGWHTGAGMSYLYNSDVKHYHDNFWVTADMKRLSGTTTLDNEILKDTDDKKSSKTFVGGTKVDDQHASIGMDFENQDKTLTAKKSYFILNDKIVFLGTGIKSTDSSKNPVTTIENRKANGYTLYTDDKQTTNSDNQENNSVFLESTDTKKNIGYHFLNKPKITVKKESHTGKWKEINKSQKDTQKTDEYYEVTQKHSNSDNKYGYVLYPGLSKDVFKTKKDEVTVVKQEDDFHVVKDNESVWAGVNYSNSTQTFDINNTKVEVKAKGMFILKKKDDNTYECSFYNPESTNSASDIESKISMTGYSITNKNTSTSNESGVHFELTK

SEQ ID NO: 93 - protein, 166 aa, Staphylococcus aureus
MKKLVTATTLTAGIGTALVGQAHHADAAENYTNYNNYNYNTTQTTTTTTTTTTTSSISHSGNLYTAGQCTWYVYDKVGGEIGSTWGNANNWAAAAQGAGFTVNHTPSKGAILQSSEGPFGHVAYVESVNSDGSVTISEMNYSGGPFSVSSRTISASEAGNYNYIHI

SEQ ID NO: 94 - protein, 516 aa, Staphylococcus aureus
MKKKLGMLLLVPAVTLSLAACGNDDGKDKDGKVTIKTTVYPLQSFAEQIGGKHVKVSSIYPAGTDLHSYEPTQKDILSASKSDLFMYTGDNLDPVAKKVASTIKDKDKKLSLEDKLDKAKLLTDQHEHGEEHEHEGHDHEKEEHHHHHGGYDPHVWLDPKINQTFAKEIKDELVKKDPKHKDDYEKNYKKLNDDLKKIDNDMKQVTKDKQGNAVFISHESIGYLADCYGFVQKGIQNMNAEDPSQKELTKIVKEIRDSNAKYILYEDNVANKVTETIRKETDAKPLKFYNMESLNKEQQKKDNITYQSLMKSNIENIGKALDSGVKVKDDKAESKHDKAISDGYFKDEQVKDRELSDYAGEWQSVYPYLKDGTLDEVMEHKAENDPKKSAKDLKAYYDKGYKTDITNIDIKGNEITFTKDGKKHTGKYEYNGKKTLKYPKGNRGVRFMFKLVDGNDKDLPKFIQFSDHNIAPKKAEHFHIFMGNDNDALLKEMDNWPTYYPSKLNKDQIKEEMLAH

SEQ ID NO: 95 - protein, 309 aa, Staphylococcus aureus
MIKNKILTATLAVGLIAPLANPFIEISKAENKIEDIGQGAEIIKRTQDITSKRLAITQNIQFDFVKDKKYNKDALVVKMQGFISSRTTYSDLKKYPYIKRMIWPFQYNISLKTKDSNVDLINYLPKNKIDSADVSQKLGYNIGGNFQSAPSIGGSGSFNYSKTISYNQKNYVTEVESQNSKGVKWGVKANSFVTPNGQVSAYDQYLFAQDPTGPAARDYFVPDNQLPPLIQSGFNPSFITTLSHERGKGDKSEFEITYGRNMDATYAYVTRHRLAVDRKHDAFKNRNVTVKYEVNWKTHEVKIKSITPK

SEQ ID NO: 96 - protein, 532 aa, Staphylococcus aureus
MRKLTKMSAMLLASGLILTGCGGNKGLEEKKENKQLTYTTVKDIGDMNPHVYGGSMSAESMIYEPLVRNTKDGIKPLLAKKWDVSEDGKTYTFHLRDDVKFHDGTPFDADAVKKNIDAVQENKKLHSWLKISTLIDNVKVKDKYTVELNLKEAYQPALAELAMPRPYVFVSPKDFKNGTTKDGVKKFDGTGPFKLGEHKKDESADFNKNDQYWGEKSKLNKVQAKVMPAGETAFLSMKKGETNFAFTDDRGTDSLDKDSLKQLKDTGDYQVKRSQPMNTKMLVVNSGKKDNAVSDKTVRQAIGHMVNRDKIAKEILDGQEKPATQLFAKNVTDINFDMPTRKYDLKKAESLLDEAGWKKGKDSDVRQKDGKNLEMAMYYDKGSSSQKEQAEYLQAEFKKMGIKLNINGETSDKIAERRTSGDYDLMFNQTWGLLYDPQSTIAAFKEKNGYESATSGIENKDKIYNSIDDAFKIQNGKERSDAYKNILKQIDDEGIFIPISHGSMTVVAPKDLEKVSFTQSQYELPFNEMQYK

SEQ ID NO: 97 - protein, 264 aa, Staphylococcus aureus
MIHSKKLTLGICLVLLIILIVGYVIMTKTNGRNAQIKDTFNQTLKLYPTKNLDDFYDKEGFRDQEFKKGDKGTWIVNSEMVIEPKGKDMETRGMVLYINRNTRTTKGYYFISEMTDDSNGRPKDDEKRYPVKMEHNKIIPTKPLPNDKLKKEIENFKFFVQYGNFKDINDYKDGDISYNPNVPSYSAKYQLNNDDYNVQQLRKRYDIPTKQAPKLLLKGDGDLKGSSVGSRSLEFTFVENKEENIYFTDSVQYTPSEDTRYESN

SEQ ID NO: 98 - protein, 261 aa, Staphylococcus aureus
MIHSKKLTLGICLVLLIILIGGCVIMTKTNGRNAQIKENFNKTLSVYLTKNLDDFYDKEGFRDQEFDKRDKGTWIIYSEMVIEPKGKNMESRGMVLYINRNTRTTKGNFIVTEITEDSKGYSRSKEKKYPVKMENNRIIPTKPIPDDKLKKEIENFKFFVQYGNFKDFKDYKNGDISYNPNVPSYSAKYQLNNDDYNVQQLRKRYHIPTKQAPELKLKGSGNLKGSSVGSKDLEFTFVENQEENIYFSDSVEFTPSEDDKS

SEQ ID NO: 99 - protein, 498 aa, Staphylococcus aureus
MAALTLLSTLSPAALAIDSKNKPANSDIKFEVTQKSDAVKALKELPKSENVKNIYQDYAVTDVKTDKKGFTHYTLQPSVDGVHAPDKEVKVHADKSGKVVLINGDTDAKKVKPTNKVTLSKDDAADKAFKAVKIDKNKAKNLKDKVIKENKVEIDGDSNKYVYNVELITVTPEISHWKVKIDAQTGEILEKMNLVKEAAETGKGKGVLGDTKDININSIDGGFSLEDLTHQGKLSAFSFNDQTGQATLITNEDENFVKDEQRAGVDANYYAKQTYDYYKDTFGRESYDNQGSPIVSLTHVNNYGGQDNRNNAAWIGDKMIYGDGDGRTFTSLSGANDVVAHELTHGVTQETANLEYKDQSGALNESFSDVFGYFVDDEDFLMGEDVYTPGKEGDALRSMSNPEQFGQPAHMKDYVFTEKDNGGVHTNSGIPNKAAYNVIQAIGKSKSEQIYYRALTEYLTSNSNFKDCKDALYQAAKDLYDEQTAEQVYEAWNEVGVE

SEQ ID NO: 100 - protein, 680 aa, Staphylococcus aureus
MKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKKSSLNNKNIQRDTTKNNNANPSDVNQGLEQAINDGKQSKVASQQQSKEADNSQDSNANNNLPSQSRIKEAPSLNKLDQTSQREIVNETEIEKVQPQQNNQANDKITNYNFNNEQEVKPQKDEKTLSVSDLKNNQKSPVEPTKDNDKKNGLNLLKSSAVATLPNKGTKELTAKAKDDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGNREEIEYQKKHGGEISPLFKGNHDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTKATDKIQKGIWQVTPTKHDWDHVDFVGQDSSDTVRTREELQDFWHHLADDLVKTEKLTDTKQA

SEQ ID NO: 101 - protein, 328 aa, Staphylococcus aureus
MKKCIKTLFLSIILVVMSGWYHSAHASDSLSKSPENWMSKLDDGKHLTEINIPGSHDSGSFTLKDPVKSVWAKTQDKDYLTQMKSGVRFFDIRGRASADNMISVHHGMVYLHHELGKFLDDAKYYLSAYPNETIVMSMKKDYDSDSKVTKTFEEIFREYYYNNPQYQNLFYTGSNANPTLKETKGKIVLFNRMGGTYIKSGYGADTSGIQWADNATFETKINNGSLNLKVQDEYKDYYDKKVEAVKNLLAKAKTDSNKDNVYVNFLSVASGGSAFNSTYNYASHINPEIAKTIKANGKARTGWLIVDYAGYTWPGYDDIVSEIIDSNK

SEQ ID NO: 102 - protein, 257 aa, Staphylococcus aureus
MKAHKIFWLNLAAIIIISIVVSGDMFLAMKWEQIHLKDGLKKVLSTYPIKNLETLYEIDGHDNPHYENNDQDTWYIESSYSVVGSDELLKEDRMLLKVDKNTHKITGEYDTTTNDRKNATDSTYKSYPVKVVNNKIVFTKDVKDPALKQKIENNQFLIQSGDLTSILNSNDLKVTHDPTTDYYNLSGKLSNDNPNVKQLKRRYNIPKNASTKVELKGMSDLKGNNHQDQKLYFYFSSPGKDQIIYKESLTYNKISEH

SEQ ID NO: 103 - protein, 423 aa, Staphylococcus aureus
MSKILKCITLAVVMLLIVTACGPNRSKEDIDKALNKDNSKDKPNQLTMWVDGDKQMAFYKKITDQYTKKTGIKVKLVNIGQNDQLENISLDAPAGKGPDIFFLAHDNTGSAYLQGLAAEIKLSKDELKGFNKQALKAMNYDNKQLALPAIVETTALFYNKKLVKNAPQTLEEVEANAAKLTDSKKKQYGMLFDAKNFYFNYPFLFGNDDYIFKKNGSEYDIHQLGLNSKHVVKNAERLQKWYDKGYLPKAATHDVMIGLFKEGKVGQFVTGPWNINEYQETFGKDLGVTTLPTDGGKPMKPFLGVRGWYLSEYSKHKYWAKDLMLYITSKDTLQKYTDEMSEITGRVDVKSSNPNLKVFEKQARHAEPMPNIPEMRQVWEPMGNASIFISNGKNPKQALDEATNDITQNIKILHPSQNDKKGD

SEQ ID NO: 104 - protein, 560 aa, Staphylococcus aureus
MLITAAMVCSFGLLKSQAAEQQSISDVYSVITDAKSALSNNSISNDNKQKAIEQVVSAVKKLSLEDNSESNAVKSDVRKLEDAKANDNQKDTLSQLTKSLIAYEEKLASKDAGSKIKLLQQQVDAKDAAMTKAIKDKNKAELESLNNSLNQIWTSNETVIRNYDANQYGQIEVALLQLRIAIHKSPLDTAKVSHAWTTFKSNIDHVDKKSNTSANDQYHVSQLNDALEKAIKAIDDNQLSDADAALTHFIETWPYVEGQIQTKDGALYTKIEDKIPYYQSVLDEHNKAHVKDGLVDLNNQIKEVVGHSYSFVDVMIIFLREGLEVLLIVMTLTTMTRNVKDKKGTASVIGGAIAGLVLSIILAITFVETLGNSGILRESMEAGLGIVAVILMFIVGVWMHKRSNAKRWNDMIKNMYANAISNGNLVLLATIGLISVLREGVEVIIFYMGMIGELATKDFIIGIALAIVILIIFALLFRFIVKLIPIFYIFRVLSIFIFIMGFKMLGVSIQKLQLLGAMPRHVIEGFPTINWLGFYPSYEPLIAQGAYIMVVAILIFKFKK

SEQ ID NO: 105 - protein, 334 aa, Staphylococcus aureus
MQKKVIAAIIGTSAISAVAATQANAATTHTVKPGESVWAISNKYGISIAKLKSLNNLTSNLIFPNQVLKVSGSSNSTSNSSRPSTNSGGGSYYTVQAGDSLSLIASKYGTTYQNIMRLNGLNNFFIYPGQKLKVSGTASSSNAASNSSRPSTNSGGGSYYTVQAGDSLSLIASKYGTTYQKIMSLNGLNNFFIYPGQKLKVTGNASTNSGSATTTNRGYNTPVFSHQNLYTWGQCTYHVFNRRAEIGKGISTYWWNANNWDNAAAADGYTIDNRPTVGSIAQTDVGYYGHVMFVERVNNDGSILVSEMNYSAAPGILTYRTVPAYQVNNYRYIH

SEQ ID NO: 106 - protein, 279 aa, Staphylococcus aureus
MKKSLTVTVSSVLAFLALNNAAHAQQHGTQVKTPVQHNYVSNVQAQTQSPTTYTVVAGDSLYKIALEHHLTLNQLYSYNPGVTPLIFPGDVISLVPQNKVKQTKAVKSPVRKASQAKKVVKQPVQQASKKVVVKQAPKQAVTKTVNVAYKPAQVQKSVPTVPVAHNYNKSVANRGNLYAYGNCTYYAFDRRAQLGRSIGSLWGNANNWNYAAKVAGFKVDKTPEVGAIFQTAAGPYGHVGVVESVNPNGTITVSEMNYAGFNVKSSRTILNPGKYNYIH

SEQ ID NO: 107 - protein, 346 aa, Staphylococcus aureus
MIIAIIILIFISFFFSGSETALTAANKTKFKTEADKGDKKAKGIVKLLEKPSEFITTILIGNNVANILLPTLVTIMALRWGISVGIASAVLTVVIILISEVIPKSVAATFPDKITRLVYPIINICVIVFRPITLLLNKLTDSINRSLSKGQPQEHQFSKEEFKTMLAIAGHEGALNEIETSRLEGVINFENLKVKDVDTTPRINVTAFASNATYEEVYETVMNKPYTRYPVYEGDIDNIIGVFHSKYLLAWSNKKENQITNYSAKPLFVNEHNKAEWVLRKMTISRKHLAIVLDEFGGTEAIVSHEDLIEELLGMEIEDEMDKKEKEKLSQQQIQFQQRKNRNVSI

SEQ ID NO: 108 - protein, 391 aa, Staphylococcus aureus
MKLKPFLPILISGAVFIVFLLLPASWFTGLVNEKTVEDNRTSLTDQVLKGTLIQDKLYESNKYYPIYGSSELGKDDPFNPAIALNKHNANKKAFLLGAGGSTDLINAVELASQYDKLKGKKLTFIISPQWFTNHGLTNQNFDARMSQTQINQMFQQKNMSTELKRRYAQRLLQFPHVHNKEYLKSYAKNPKETKDSYISGFKENQLIKIEAIKSLFAMDKSPLEHVKPATKPDASWDEMKQKAVEIGKADTTSNKFGIRDQYWKLIQESKRKVRRDYEFNVNSPEFQDLELLVKTMRAAGADVQYVSIPSNGVWYDHIGIDKERRQAVYKKIHSTVVDNGGKIYDMTDKDYEKYVISDAVHIGWKGWVYMDEQIAKHMKGEPQPEVDKPKN

SEQ ID NO: 109 - protein, 1256 aa, Staphylococcus aureus
MAKKFNYKLPSMVALTLVGSAVTAHQVQAAETTQDQTTNKNVLDSNKVKATTEQAKAEVKNPTQNISGTQVYQDPAIVQPKTANNKTGNAQVSQKVDTAQVNGDTRANQSATTNNTQPVAKSTSTTAPKTNTNVTNAGYSLVDDEDDNSENQINPELIKSAAKPAALETQYKTAAPKAATTSAPKAKTEATPKVTTFSASAQPRSVAATPKTSLPKYKPQVNSSINDYICKNNLKAPKIEEDYTSYFPKYAYRNGVGRPEGIVVHDTANDRSTINGEISYMKNNYQNAFVHAFVDGDRIIETAPTDYLSWGVGAVGNPRFINVEIVHTHDYASFARSMNNYADYAATQLQYYGLKPDSAEYDGNGTVWTHYAVSKYLGGTDHADPHGYLRSHNYSYDQLYDLINEKYLIKMGKVAPWGTQSTTTPTTPSKPTTPSKPSTGKLTVAANNGVAQIKPTNSGLYTTVYDKTGKATNEVQKTFAVSKTATLGNQKFYLVQDYNSGNKFGWVKEGDVVYNTAKSPVNVNQSYSIKPGTKLYTVPWGTSKQVAGSVSGSGNQTFKASKQQQIDKSIYLYGSVNGKSGWVSKAYLVDTAKPTPTPTPKPSTPTTNNKLTVSSLNGVAQINAKNNGLFTTVYDKTGKPTKEVQKTFAVTKEASLGGNKFYLVKDYNSPTLIGWVKQGDVIYNNAKSPVNVMQTYTVKPGTKLYSVPWGTYKQEAGAVSGTGNQTFKATKQQQIDKSIYLFGTVNGKSGWVSKAYLAVPAAPKKAVAQPKTAVKAYTVTKPQTTQTVSKIAQVKPNNTGIRASVYEKTAKNGAKYADRTFYVTKERAHGNETYVLLNNTSHNIPLGWFNVKDLNVQNLGKEVKTTQKYTVNKSNNGLSMVPWGTKNQVILTGNNIAQGTFNATKQVSVGKDVYLYGTINNRTGWVNAKDLTAPTAVKPTTSAAKDYNYTYVIKNGNGYYYVTPNSDTAKYSLKAFNEQPFAVVKEQVINGQTWYYGKLSNGKLAWIKSTDLAKELIKYNQTGMTLNQVAQIQAGLQYKPQVQRVPGKWTDAKFNDVKHAMDTKRLAQDPALKYQFLRLDQPQNISIDKINQFLKGKGVLENQGAAFNKAAQMYGINEVYLISHALLETGNGTSQLAKGADVVNNKVVTNSNTKYHNVFGIAAYDNDPLREGIKYAKQAGWDTVSKAIVGGAKFIGNSYVKAGQNTLYKMRWNPAHPGTHQYATDVDWANINAKIIKGYYDKIGEVGKYFDIPQYK

SEQ ID NO: 110 - protein, 414 aa, Staphylococcus aureus
MKFSTLSEEEFTNYTKKHFKHYTQSIELYNYRNKINHEAHIVGVKNDKNEVIAACLLTEARIFKFYKYFYSHRGPLLDYFDAKLVCYFFKELSKFIYKNRGVFILVDPYLIENLRDANGRIIKNYNNSVIVKMLGKIGYLHQGYTTGYSNKSQIRWISVLDLKDKDENQLLKEMEYQTRRNIKKTIEIGVKVEDLSIEETNRFYKLFQMAEEKHGFHFMNEDYFKRMQEIYKDKAMLKIACINLNEYQDKLKIQLLKIENEMMTVNRALNENPNSKKNKSKLNQLNMQLSSINNRISKTEELIFEDGPVLDLAAALFICTDDEVYYLSSGSNPKYNQYMGAYHLQWHMIKYAKSHNINRYNFYGITGVFSNEADDFGVQQFKKGFNAHVEELIGDFIKPVRPILYKFAKLIYKV

SEQ ID NO: 111 - protein, 428 aa, Staphylococcus aureus
MKERYYELIDERVFEQELENGLRLFIIPKPGFQKTFVTYTTQFGSLDNQFKPLGQDQFVTVPDGVAHFLEHKLFEKEEEDLFTAFAEDNAQANAFTSFDRTSYLFSATDNIENNIKRLLTMVETPYFTKETVDKEKGIIAEEIKMYQEQPGYKLMFNTLRAMYQQHPIRVDIAGSVESIYDITKDDLYLCYETFYHPSNMVLFVVGDVDPEAICRIVKQHEDARNKVNQPKIERGLVDEPEDVKEAFVTESMKIQSPRLMLGFKNKPLQEAPQKYVQRDLEMSLFFELIFGEETDFYQNLLNEGLIDDTFGYQFVLEPTYSFSIVTSATEEPDKLKKLLLDELRDKKGNFQDAEAFELLKKQFIGEFISSLNSPEYIANQYTKLYFEGVSVFDMLDIVENITLDSINETSSLYLNLDQQVDSRLEIKK

SEQ ID NO: 112 - protein, 519 aa, Staphylococcus aureus
MNLLSLLLILLGIILGVVGGYVVARNLLLQKQSQARQTAEDIVNQAHKEADNIKKEKLLEAKEENQILREQTEAELRERRSELQRQETRLLQKEENLERKSDLLDKKDEILEQKESKIEEKQQQVDAKESSVQTLIMKHEQELERISGLTQEEAINEQLQRVEEELSQDIAVLVKEKEKEAKEKVDKTAKELLATAVQRLAADHTSESTVSVVNLPNDEMKGRIIGREGRNIRTLETLTGIDLIIDDTPEAVILSGFDPIRREIARTALVNLVSDGRIHPGRIEDMVEKARKEVDDIIREAGEQATFEVNAHNMHPDLVKIVGRLNYRTSYGQNVLKHSIEVAHLASMLAAELGEDETLAKRAGLLHDVGKAIDHEVEGSHVEIGVELAKKYGENETVINAIHSHHGDVEPTSIISILVAAADALSAARPGARKETLENYIRRLERLETLSESYDGVEKAFAIQAGREIRVIVSPEEIDDLKSYRLARDIKNQIEDELQYPGHIKVTVVRETRAVEYAK

SEQ ID NO: 113 - protein, 284 aa, Staphylococcus aureus
MSFYVVLIIIIVALIGILVLNQRYSNSKIDTEVYARKQLIKKNKALSAENAELRSQMLSSNNDVGHHAYKNAKRELRKILDSYLENGKLKYYDIIVTSNLATKHPFFEYARSFDFIIVSDIGLINVDVKSWGEKTFYHFDVPDEHDTEISNSNIEKVVGHYISQQYHDQFNSSRKSIYTFTETVQPNRVIYDFYDYDPYQLAANNAKALKDHIEQNFNFKVQSTGVIYFSDGTVNIIQGSEERDKYVDTVSTKSSLRRIISEAIELSKHPLNKEQVDQITAIFK

SEQ ID NO: 114 - protein, 1274 aa, Staphylococcus aureus
MSWFDKLFGEDNDSNDDLIHRKKKRRQESQNIDNDHDSLLPQNNDIYSRPRGKFRFPMSVAYENENVEQSADTISDEKEQYHRDYRKQSHDSRSQKRHRRRRNQTTEEQNYSEQRGNSKISQQSIKYKDHSHYHTNKPGTYVSAINGIEKETHKPKTHNMYSNNTNHRAKDSTPDYHKESFKTSEVPSAIFGTMKPKKLENGRIPVSKPSEKVESDKQKYDKYVAKTQTSQNKQLEQEKQNDSVVKQGTASKSSDENVSSTTKSMPNYSKVDNTIKIENIYASQIVEEIRRERERKVLQKRRFKKALQQKREEHKNEEQDAIQRAIDEMYAKQAERYVGDSSLNDDSDLTDNSTDASQLHTNGIENETVSNDENKQASIQNEDTNDTHVDESPYNYEEVSLNQVSTTKQLSDDEVTVSNVTSQHQSALQHNVEVNDKDELKNQSRLIADSEEDGATNKEEYSGSQIDDAEFYELNDTEVDEDTTSNIEDNTNRNASEMHVDAPKTQEYAVTESQVNNIDKTVDNEIELAPRHKKDDQTNLSVNSLKTNDVNDNHVVEDSSMNEIEKNNAEITENVQNEAAESEQNVEEKTIENVNPKKQTEKVSTLSKRPFNVVMTPSDKKRMMDRKKHSKVNVPELKPVQSKQAVSERMPASQATPSSRSDSQESNTNAYKTNNMTSNNVENNQLIGHAETENDYQNAQQYSEQKPSVDSTQTEIFEESQDDNQLENEQVDQSTSSSVSEVSDITEESEETTHPNNTSGQQDNDDQQKDLQSSFSNKNEDTANENRPRTNQQDVATNQAVQTSKPMIRKGPNIKLPSVSLLEEPQVIESDEDWITDKKKELNDALFYFNVPAEVQDVTEGPSVTRFELSVEKGVKVSRITALQDDIKMALAAKDIRIEAPIPGTSRVGIEVPNQNPTTVNLRSIIESPSFKNAESKLTVAMGYRINNEPLLMDIAKTPHALIAGATGSGKSVCINSILMSLLYKNHPEELRLLLIDPKMVELAPYNGLPHLVAPVITDVKAATQSLKWAVEEMERRYKLFAHYHVRNITAFNKKAPYDERMPKIVIVIDELADLMMMAPQEVEQSIARIAQKARACGIHMLVATQRPSVNVITGLIKANIPTRIAFMVSSSVDSRTILDSGGAERLLGYGDMLYLGSGMNKPIRVQGTFVSDDEIDDVVDFIKQQREPDYLFEEKELLKKTQTQSQDELFDDVCAFMVNEGHISTSLIQRHFQIGYNRAARIIDQLEQLGYVSSANGSKPRDVYVTEADLNKE

SEQ ID NO: 115 - protein, 239 aa, Staphylococcus aureus
MNKNIIIKSIAALTILTSITGVGTTMVEGIQQTAKAENTVKQITNTNVAPYSGVTWMGAGTGFVVGNHTIITNKHVTYHMKVGDEIKAHPNGFYNNGGGLYKVTKIVDYPGKEDIAVVQVEEKSTQPKGRKFKDFTSKFNIASEAKENEPISVIGYPNPNGNKLQMYESTGKVLSVNGNIVSSDAIIQPGSSGSPILNSKHEAIGVIYAGNKPSGESTRGFAVYFSPEIKKFIADNLDK

SEQ ID NO: 116 - protein, 238 aa, Staphylococcus aureus
MNKNIIIKSIAALTILTSVTGVGTTVVEGIQQTAKAEHNVKLIKNTNVAPYNGVVSIGSGTGFIVGKNTIVTNKHVVAGMEIGAHIIAHPNGEYNNGGFYKVKKIVRYSGQEDIAILHVEDKAVHPKNRNFKDYTGILKIASEAKENERISIVGYPEPYINKFQMYESTGKVLSVKGNMIITDAFVEPGNSGSAVFNSKYEVVGVHFGGNGPGNKSTKGYGVYFSPEIKKFIADNTDK

SEQ ID NO: 117 - protein, 239 aa, Staphylococcus aureus
MNKNIVIKSMAALAILTSVTGINAAVVEETQQIANAEKNVTQVKDTNIFPYNGVVSFKDATGFVIGKNTIITNKHVSKDYKVGDRITAHPNGDKGNGGIYKIKSISDYPGDEDISVMNIEEQAVERGPKGFNFNENVQAFNFAKDAKVDDKIKVIGYPLPAQNSFKQFESTGTIKRIKDNILNFDAYIEPGNSGSPVLNSNNEVIGVVYGGIGKIGSEYNGAVYFTPQIKDFIQKHIEQ

SEQ ID NO: 118 - protein, 240 aa, Staphylococcus aureus
MNKNVVIKSLAALTILTSVTGIGTTLVEEVQQTAKAENNVTKVKDTNIFPYTGVVAFKSATGFVVGKNTILTNKHVSKNYKVGDRITAHPNSDKGNGGIYSIKKIINYPGKEDVSVIQVEERAIERGPKGFNFNDNVTPFKYAAGAKAGERIKVIGYPHPYKNKYVLYESTGPVMSVEGSSIVYSAHTESGNSGSPVLNSNNELVGIHFASDVKNDDNRNAYGVYFTPEIKKFIAENIDK

SEQ ID NO: 119 - protein, 235 aa, Staphylococcus aureus
MNKNVMVKGLTALTILTSLGFAENISNQPHSIAKAEKNVKEITDATKEPYNSVVAFVGGTGVVVGKNTIVTNKHIAKSNDIFKNRVSAHHSSKGKGGGNYDVKDIVEYPGKEDLAIVHVHETSTEGLNFNKNVSYTKFADGAKVKDRISVIGYPKGAQTKYKMFESTGTINHISGTFMEFDAYAQPGNSGSPVLNSKHELIGILYAGSGKDESEKNFGVYFTPQLKEFIQNNIEK

SEQ ID NO: 120 - protein, 163 aa, Staphylococcus aureus
MLKRSLLFLTVLLLLFSFSSITNEVSASSSFDKGKYKKGDDASYFEPTGPYLMVNVTGVDGKGNELLSPHYVEFPIKPGTTLTKEKIEYYVEWALDATAYKEFRVVELDPSAKIEVTYYDKNKKKEETKSFPITEKGFVVPDLSEHIKNPGFNLITKVIIEKK

SEQ ID NO: 121 - protein, 290 aa, Staphylococcus aureus
MKKKALLPLFLGIMVFLAGCDYSKPEKRSGFFYNTFVDPMKNVLDWLGNNLLNDNYGLAIIILVLVIRIILLPFMLSNYKNSHMMRQKMKVAKPEVEKIQEKVKRARTQEEKMAANQELMQVYKKYDMNPIKSMLGCLPMLIQLPIIMGLYFVLKDQLVDGLFKYPHFLWFDLGRPDIWITIIAGVLYFIQAYVSSKTMPDEQRQMGYMMMVISPIMIIWISLSSASALGLYWSVSAAFLVVQTHFANIYYEKVAKKEVQPFIEAYEREHNGGSNKKGKNTQVVSKKKKK

SEQ ID NO: 122 - protein, 460 aa, Staphylococcus aureus
MKSCPKCGQQAQDDVQICTQCGHKFDSRQALYRKSTDEDIQTNNIKMRKMVPWAIGFFILILIIILFFLLRNFNSPEAQTKILVNAIENNDKQKVATLLSTKDNKVDSEEAKVYINYIKDEVGLKQFVSDLKNTVHKLNKSKTSVASYIQTRSGQNILRVSKNGTRYIFFDNMSFTAPTKQPIVKPKEKTKYEFKSGGKKKMVIAEANKVTPIGNFIPGTYRIPAMKSTENGDFAGHLKFDFRQSNSETVDVTEDFEEANISVTLKGDTKLNDSSKKVTINDHEMAFSSSKTYGPYPQNKDITISASGKAKDKTFTTQTKTIKASDLKYNTEITLNFDSEDIEDYVEKKEKEENSLKNKLIEFFAGYSLANNAAFNQSDFDFVSSYIKKGSSFYDDVKKRVSKGSLMMISSPQIIDAEKHGDKITATVRLINENGKQVDKEYELEQGSQDRLQLIKTSEK

SEQ ID NO: 123 - protein, 322 aa, Staphylococcus aureus
MRKKWSTLAFGFLVAAYAHIRIKEKRSVKSYMLEQGIRLSRAKRRFMYKEEAMKALEKMAPQTAGEYEGTNYQFKMPVKVDKHFGSTVYTVNDKQDKHQRVVLYAHGGAWFQDPLKIHFEFIDELAETLNAKVIMPVYPKIPHQDYQATYVLFEKLYHDLLNQVADSKQIVVMGDSAGGQIALSFAQLLKEKHIVQPGHIVLISPVLDATMQHPEIPDYLKKDPMVGVDGSVFLAEQWAGDTPLDNYKVSPINGDLDGLGRITLTVGTKEVLYPDALNLSQLLSAKGIEHDFIPGYYQFHIYPVFPIPERRRFLYQVKNIIN

SEQ ID NO: 124 - protein, 143 aa, Staphylococcus aureus
MEYKKILIRLLIAFAVLFSADFTYQSVEQTHQSHAAVNYYSKNQCTWWAFKRRAQVGKPVSNRWGNAKNWYYNARKSKYATGRTPRKFAVMQSTAGYYGHVAVVEQVYKNGSIKVSEYNFYRPLKYNTRVLSKKAARNFNYIY

SEQ ID NO: 125 - protein, 255 aa, Staphylococcus aureus
MKKIVTATIATAGLATIAFAGHDAQAAEQNNNGYNSNDAQSYSYTYTIDAQGNYHYTWTGNWNPSQLTQNNTYYYNNYNTYSYNNASYNNYYNHSYQYNNYTNNSQTATNNYYTGGSGASYSTTSNNVHVTTTAAPSSNGRSISNGYASGSNLYTSGQCTYYVFDRVGGKIGSTWGNASNWANAAASSGYTVNNTPKVGAIMQTTQGYYGHVAYVEGVNSNGSVRVSEMNYGHGAGVVTSRTISANQAGSYNFIH

SEQ ID NO: 126 - protein, 131 aa, Staphylococcus aureus
MKKLIISIMAVMLFLTGCGKSQEKATLEKDIDNLQKENKELKDKKEKLQQEKEKLADKQKDLEKEVKDLKPSKEDNKDDKKDEDKNKDKDKDKEASQDKQSKDQTKSSDKDNHKKPTSADKDQKANDKHQS

SEQ ID NO: 127 - protein, 192 aa, Staphylococcus aureus
MTKRPKRILATIIIFLSLLFTIIYIDDIQKWFNQYTDKLTQNHKGQGHSKWEDFFRGSRITETFGKYQHSPFDGKHYGIDFALPKGTPIKAPTNGKVTRIFNNELGGKVLQIAEDNGEYHQWYLHLDKYNVKVGDRVKAGDIIAYSGNTGIQTTGAHLHFQRMKGGVGNAYAEDPKPFIDQLPDGERSLYDL

SEQ ID NO: 128 - protein, 505 aa, Staphylococcus aureus
MTQQQNDKRTLKNKHTYQNEPLPNRKDFVVSFITGALVGSALGLYFKNKVYQKADDLKVKEQELSQKFEERKTQLEETVAYTKERVEGFLNKSKNEQAALKAQQAAIKEEASANNLSDTSQEAQEIQEAKREAQAEADKSVAVSNKESKAVALKAQQAAIKEEASANNLSDTSQEAQEIQEAKKEAQAETDKSAAVSNEEPKAVALKAQQAAIKEEASANNLSDTSQEAQEVQEAKKEAQAETDKSAAVSNEEPKAVALKAQQAAIKEEASANNLSDISQEAQEVQEAKKEAQAEKDSDTLTKDASAAKVEVSKPESQAERLANAAKQKQAKLTPGSKESQLTEALFAEKPVAKNDLKEIPQLVTKKNDVSETETVNIDNKDTVKQKEAKFENGVITRKADEKTTNNTAVDKKSGKQSKKTTPSNKRNASKASTNKTSGQKKQHNKKSSQGAKKQSSSSKSTQKNNQTSNKNSKTTNAKSSNASKTPNAKVEKAKSKIEKRTFND

SEQ ID NO: 129 - protein, 305 aa, Staphylococcus aureus
MFKRTKLILIATLLLSGCSTTNNESNKETKSVPEEMEASKYVGQGFQPPAEKDVVEFAKKHKDKIAKRGEQFFMDNFGLKVKATNVVGSGKGVEVFVHCDDHDIVFNASIPFDKSIIESDSSLRSEDKGDDMSTLVGTVLSGFEYRTQKEKYDNLYKFFKDNEEKYQYTGFTKEAINKTQNVGYKNEYFYITYSSRSLKEYRKYYEPLIHKNDKEFKEGMEQARKEVNYAANTDTVTTLFSTKENFTKDNTVDDVIELSDKLYNFKNKPEKSTITIQIGKPTINTKKAFYDDNDPIEYGVYRKDE

SEQ ID NO: 130 - protein, 226 aa, Staphylococcus aureus
MKFKAIAKASLALGMLATGVITSNVQSVQAKAEVKQQSESELKHYYNKPILERKNVTGFKYTDEGKHYLEVTVGQQHSRITLLGSDKDKFKDGENSNIDVFILREGDSRQATNYSIGGVTKSNSVQYIDYINTPILEIKKDNEDVLKDFYYISKEDISLKELDYRLRERAIKQHGLYSNGLKQGQITITMNDGTTHTIDLSQKLEKERMGESIDGTKINKILVEMK

SEQ ID NO: 131 - protein, 231 aa, Staphylococcus aureus
MKMKNIAKISLLLGILATGVNTTTEKPVHAEKKPIVISENSKKLKAYYNQPSIEYKNVTGYISFIQPSIKFMNIIDGNSVNNIALIGKDKQHYHTGVHRNLNIFYVNEDKRFEGAKYSIGGITSANDKAVDLIAEARVIKEDHTGEYDYDFFPFKIDKEAMSLKEIDFKLRKYLIDNYGLYGEMSTGKITVKKKYYGKYTFELDKKLQEDRMSDVINVTDIDRIEIKVIKA

SEQ ID NO: 132 - protein, 356 aa, Staphylococcus aureus
MKMRTIAKTSLALGLLTTGAITVTTQSVKAEKIQSTKVDKVPTLKAERLAMINITAGANSATTQAANTRQERTPKLEKAPNTNEEKTSASKIEKISQPKQEEQKTLNISATPAPKQEQSQTTTESTTPKTKVTTPPSTNTPQPMQSTKSDTPQSPTIKQAQTDMTPKYEDLRAYYTKPSFEFEKQFGFMLKPWTTVRFMNVIPNRFIYKIALVGKDEKKYKDGPYDNIDVFIVLEDNKYQLKKYSVGGITKTNSKKVNHKVELSITKKDNQGMISRDVSEYMITKEEISLKELDFKLRKQLIEKHNLYGNMGSGTIVIKMKNGGKYTFELHKKLQEHRMADVIDGTNIDNIEVNIK

SEQ ID NO: 133 - protein, 308 aa, Staphylococcus aureus
MKITTIAKTSLALGLLTTGVITTTTQAANATTLSSTKVEAPQSTPPSTKIEAPQSKPNATTPPSTKVEAPQQTANATTPPSTKVTTPPSTNTPQPMQSTKSDTPQSPTTKQVPTEINPKFKDLRAYYTKPSLEFKNEIGIILKKWTTIRFMNVVPDYFIYKIALVGKDDKKYGEGVHRNVDVFVVLEENNYNLEKYSVGGITKSNSKKVDHKAGVRITKEDNKGTISHDVSEFKITKEQISLKELDFKLRKQLIEKNNLYGNVGSGKIVIKMKNGGKYTFELHKKLQENRMADVIDGTNIDNIEVNIK

SEQ ID NO: 134 - protein, 234 aa, Staphylococcus aureus
MKMTAIAKASLALGILATGTITSLHQTVNASEHKAKYENVTKDIFDLRDYYSGASKELKNVTGYRYSKGGKHYLIFDKNRKFTRVQIFGKDIERFKARKNPGLDIFVVKEAENRNGTVFSYGGVTKKNQDAYYDYINAPRFQIKRDEGDGIATYGRVHYIYKEEISLKELDFKLRQYLIQNFDLYKKFPKDSKIKVIMKDGGYYTFELNKKLQTNRMSDVIDGRNIEKIEANIR

SEQ ID NO: 135 - protein, 231 aa, Staphylococcus aureus
MKLKTLAKATLVLGLLATGVITTESQTVKAAESTQGQHNYKSLKYYYSKPSIELKNLDGLYRQKVTDKGVYVWKDRKDYFVGLLGKDIEKYPQGEHDKQDAFLVIEEETVNGRQYSIGGLSKTNSKEFSKEVDVKVTRKIDESSEKSKDSKFKITKEEISLKELDFKLRKKLMEEEKLYGAVNNRKGKIVVKMEDDKFYTFELTKKLQPHRMGDTIDGTKIKEINVELEYK

SEQ ID NO: 136 - protein, 231 aa, Staphylococcus aureus
MKLKTLAKATLALGLLTTGVITSEGQAVQAKEKQERVQHLYDIKDLHRYYSSESFEFSNISGKVENYNGSNVVRFNQENQNHQLFLLGKDKEKYKEGIEGKDVFVVKELIDPNGRLSTVGGVTKKNNKSSETNTHLFVNKVYGGNLDASIDSFSINKEEVSLKELDFKIRQHLVKNYGLYKGTTKYGKITINLKDGEKQEIDLGDKLQFERMGDVLNSKDINKIEVTLKQI

SEQ ID NO: 137 - protein, 232 aa, Staphylococcus aureus
MKFTVIAKAIFILGILTTSVMITENQSVNAKGKYEKMNRLYDTNKLHQYYSGPSYELTNVSGQSQGYYDSNVLLFNQQNQKFQVFLLGKDENKYKEKTHGLDVFAVPELVDLDGRIFSVSGVTKKNVKSIFESLRTPNLLVKKIDDKDGFSIDEFFFIQKEEVSLKELDFKIRKLLIKKYKLYEGSADKGRIVINMKDENKYEIDLSDKLDFERMADVINSEQIKNIEVNLK

SEQ ID NO: 138 - protein, 232 aa, Staphylococcus aureus
MKLTTIAKATLALGILTTGVFTAESQTGHAKVELDETQRKYYINMLHQYYSEESFEPTNISVKSEDYYGSNVLNFKQRNKAFKVFLLGDDKNKYKEKTHGLDVFAVPELIDIKGGIYSVGGITKKNVRSVFGFVSNPSLQVKKVDAKNGFSINELFFIQKEEVSLKELDFKIRKLLIEKYRLYKGTSDKGRIVINMKDEKKHEIDLSEKLSFERMFDVMDSKQIKNIEVNLN

SEQ ID NO: 139 - protein, 227 aa, Staphylococcus aureus
MKFTALAKATLALGILTTGTLTTEVHSGHAKQNQKSVNKHDKEALYRYYTGKTMEMKNISALKHGKNNLRFKFRGIKIQVLLPGNDKSKFQQRSYEGLDVFFVQEKRDKHDIFYTVGGVIQNNKTSGVVSAPILNISKEKGEDAFVKGYPYYIKKEKITLKELDYKLRKHLIEKYGLYKTISKDGRVKISLKDGSFYNLDLRSKLKFKYMGEVIESKQIKDIEVNLK

SEQ ID NO: 140 - protein, 225 aa, Staphylococcus aureus
MKLKNIAKASLALGILTTGMITTTAQPVKASTLEVRSQATQDLSEYYNRPFFEYTNQSGYKEEGKVTFTPNYQLIDVTLTGNEKQNFGEDISNVDIFVVRENSDRSGNTASIGGITKTNGSNYIDKVKDVNLIITKNIDSVTSTSTSSTYTINKEEISLKELDFKLRKHLIDKHNLYKTEPKDSKIRITMKDGGFYTFELNKKLQTHRMGDVIDGRNIEKIEVNL

SEQ ID NO: 141 - protein, 116 aa, Staphylococcus aureus
MKFKKYILTGTLALLLSSTGIATIEGNKADASSLDKYLTESQFHDKRIAEELRTLLNKSNVYALAAGSLNPYYKRTIMMNEYRAKAALKKNDFVSMADAKVALEKIYKEIDEIINR

SEQ ID NO: 142 - protein, 508 aa, Staphylococcus aureus
MKNKLLVLSLGALCVSQIWESNRASAVVSGEKNPYVSESLKLTNNKNKSRTVEEYKKSLDDLIWSFPNLDNERFDNPEYKEAMKKYQQRFMAEDEALKKFFSEEKKIKNGNTDNLDYLGLSHERYESVFNTLKKQSEEFLKEIEDIKKDNPELKDFNEEEQLKCDLELNKLENQILMLGKTFYQNYRDDVESLYSKLDLIMGYKDEERANKKAVNKRMLENKKEDLETIIDEFFSDIDKTRPNNIPVLEDEKQEEKNHKNMAQLKSDTEAAKSDESKRSKRSKRSLNTQNHKPASQEVSEQQKAEYDKRAEERKARFLDNQKIKKTPVVSLEYDFEHKQRIDNENDKKLVVSAPTKKPTSPTTYTETTTQVPMPTVERQTQQQIIYNAPKQLAGLNGESHDFTTTHQSPTTSNHTHNNVVEFEETSALPGRKSGSLVGISQIDSSHLTEREKRVIKREHVREAQKLVDNYKDTHSYKDRINAQQKVNTLSEGHQKRFNKQINKVYNGK

SEQ ID NO: 143 - protein, 208 aa, Staphylococcus aureus
MKFGKTIAVVLASSVLLAGCTTDKKEIKAYLKQVDKIKDDEEPIKTVGKKIAELDEKKKKLTEDVNSKDTAVRGKAVKDLIKNADDRLKEFEKEEDAIKKSEQDFKKAKSHVDNIDNDVKRKEVKQLDDVLKEKYKLHSDYAKAYKKAVNSEKTLFKYLNQNDATQQGVNEKSKAIEQNYKKLKEVSDKYTKVLNKVGKEKQDVDQFK

SEQ ID NO: 144 - protein, 109 aa, Staphylococcus aureus
MKKNFIGKSILSIAAISLTVSTFAGESHAQTKNVEAAKKYDQYQTNFKKQVNKKVVDAQKAVNFFKRTRTVATHRKAQRAVNLIHFQHSYEKKKLQRQIDLVLKYNTLK

SEQ ID NO: 145 - protein, 116 aa, Staphylococcus aureus
MKIRKSILAGTLAIVLASPLVTNLDKNEAQASTSLPTSNEYQNEKLANELKSLLDELNVNELATGSLNTYYKRTIKISGQKAMYALKSKDFKKMSEAKYQLQKIYNEIDEALKSKY

SEQ ID NO: 146 - protein, 149 aa, Staphylococcus aureus [sequence omitted]

SEQ ID NO: 147 - protein, 257 aa, Staphylococcus aureus
MKKTAFILLLFIALTWTTSPLVNGSEKSEEINEKDLRKKSELQGAALGNLKQIYYYNEKAKTENKESHDQFLQHTILFKGFFTNHSWYNDLLVDFDSKDIVDKYKGKKVDLYGAYYGYQCAGGTPNKTACMYGGVTLHDNNRLTEEKKVPINLWLDGKQNTVPLETVKTNKKNVTVQELDLQARRYLQEKYNLYNSDVFDGKVQRGLIVFHTSTEPSVNYDLFGAQGQNSNTLLRIYRDNKTINSENMHIDIYLYTS

SEQ ID NO: 148 - protein, 154 aa, Staphylococcus aureus
MKRLLGLLLVSTLVLSACGNDENQEESKKEVKSKEKKIEKEKENKSKKDKEKEVATQQQPDNQTVEQPQSQEQSVQQPQQQIPQNSVPQQNVQVQQNKKQKVDLNNMPPTDFSTEGMSEQAQKQIEELSMQKDYHGLSQREYNDRVSEIINNDN

SEQ ID NO: 149 - protein, 1501 aa, Staphylococcus aureus
MQMRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEPSVKAEDISKKEDTPKEVADVAEVQPKSSVTHNAETPKVRKARSVDEGSFDITRDSKNVVESTPITIQGKEHFEGYGSVDIQKKPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITTPTLKNPLTGVIISKGEPKEEITKDPINELTEYGPETIAPGHRDEFDPKLPTGKKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGVIISKGEPKEEITKDPINELTEYGPETITPGHRDEFDPKLPTGEKEEVPGKPGIKNPETGDVVRPPVDSVTKYGPVKGDSIVEKEEIPFKKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFKKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 150 - protein, 293 aa, Staphylococcus aureus
ADSDINIKTGTTDIGSNTTVKTGDLVTYDKENGMLKKVFYSFIDDKNHNKKLLVIRTKGTIAGQYRVYSEEGANKSGLAWPSAFKVQLQLPDNEVAQISDYYPRNSIDTKEYMSTLTYGFNGNVTGDDTGKIGGLIGANVSIGHTLKYVQPDFKTILESPTDKKVGWKVIFNNMVNQNWGPYDRDSWNPVYGNQLFMKTRNGSMKAADNFLDPNKASSLLSSGFSPDFATVITMDRKASKQQTNIDVIYERVRDDYQLHWTSTNWKGTNTKDKWIDRSSERYKIDWEKEEMTN

SEQ ID NO: 151 - protein, 207 aa, Artificial Sequence
  Synthetic Construct
MAMIKMSPEEIRAKSQSYGQGSDQIRQILSDLTRAQGEIAANWEGQAFSRFEEQFQQLSPKVEKFAQLLEEIKQQLNSTADAVQEQDQQLSNNFGLQASGGGSMGGYKGIKADGGKVDQAKQLAAKTAKDIEACQKQTQQLAEYIEGSDWEGQFANKVKDVLLIMAKFQEELVQPMADHQKAIDNLSQNLAKYDTLSIKQGLDRVNP

SEQ ID NO: 152 - protein, 207 aa, Artificial Sequence
  Synthetic Construct
MGGYKGIKADGGKVDQAKQLAAKTAKDIEACQKQTQQLAEYIEGSDWEGQFANKVKDVLLIMAKFQEELVQPMADHQKAIDNLSQNLAKYDTLSIKQGLDRVNPASGGGSMAMIKMSPEEIRAKSQSYGQGSDQIRQILSDLTRAQGEIAANWEGQAFSRFEEQFQQLSPKVEKFAQLLEEIKQQLNSTADAVQEQDQQLSNNFGLQ

SEQ ID NO: 153 - protein, 169 aa, Staphylococcus aureus
CGNDTPKDETKSTESNTNQDTNTTKDVIALKDVKTSPEDAVKKAEETYKGQKLKGISFENSNGEWAYKVTQQKSGEESEVLVADKNKKVINKKTEKEDTMNENDNFKYSDAIDYKKAIKEGQKEFDGDIKEWSLEKDDGKLVYNIDLKKGNKKQEVTVDAKNGKVLKSE

SEQ ID NO: 154 - protein, 106 aa, Staphylococcus aureus
CGNDTPKDETKSTESNTNQDTNTTKDVIALKDVKTSPEDAVKKAEETYKGQKLKGISFENSNGEWAYKVTQQKSGEESEVLVADKNKKVINKKTEKEDTMNENDNF

SEQ ID NO: 155 - protein, 580 aa, Staphylococcus aureus
AENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEPSTSEIQTKPTTPQESTNIENSQPQPTPSKVDNQVTDATNPKEPVNVSKEELKNNPEKLKELVRNDSNTDHSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKP

SEQ ID NO: 156 - protein, 540 aa, Staphylococcus aureus
AESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLSLKSQITVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKDVTDIKIYQVPKGYTLNKGYDVNTKELTDVTNQYLQKITYGDNNSAVIDFGNADSAYVVMVNTKFQYTNSESPTLVQMATLSSTGNKSVSTGNALGFTNNQSGGAGQEVYKIGNYVWEDTNKNGVQELGEKG

SEQ ID NO: 157 - protein, 145 aa, Staphylococcus aureus
DSQQVNAATEATNATNNQSTQVSQATSQPINFQVQKDGSSEKSHMDDYMQHPGKVIKQNNKYYFQTVLNNASFWKEYKFYNANNQELATTVVNDNKKADTRTINVAVEPGYKSLTTKVHIVVPQINYNHRYTTHLEFEKAIPTLA

SEQ ID NO: 158 - protein, 50 aa, Staphylococcus aureus
ADSDINIKTGTTDIGSNTTVKTGDLVTYDKENGMLKKVFYSFIDDKNHNK

SEQ ID NO: 159 - protein, 63 aa, Staphylococcus aureus
ADSDINIKTGTTDIGSNTTVKTGDLVTYDKENGMLKKVFYSFIDDKNHNKKLLVIRTKGTIAG

SEQ ID NO: 160 - protein, 50 aa, Staphylococcus aureus
ADSDINIKTGTTDIGSNTTVKTGDLVTYDKENGMHKKVFYSFIDDKNHNK

SEQ ID NO: 161 - protein, 63 aa, Staphylococcus aureus
ADSDINIKTGTTDIGSNTTVKTGDLVTYDKENGMHKKVFYSFIDDKNHNKKLLVIRTKGTIAG

SEQ ID NO: 162 - protein, 289 aa, Staphylococcus aureus
AQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQA

SEQ ID NO: 163 - protein, 508 aa, Staphylococcus aureus
SEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPV

SEQ ID NO: 164 - protein, 468 aa, Staphylococcus aureus
AEHTNGELNQSKNETTAPSENKTTKKVDSRQLKDNTQTATADQPKVTMSDSATVKETSSNMQSPQNATANQSTTKTSNVTTNDKSSTTYSNETDKSNLTQAKDVSTTPKTTTIKPRTLNRMAVNTVAAPQQGTNVNDKVHFSNIDIAIDKGHVNQTTGKTEFWATSSDVLKLKANYTIDDSVKEGDTFTFKYGQYFRPGSVRLPSQTQNLYNAQGNIIAKGIYDSTTNTTTYTFTNYVDQYTNVRGSFEQVAFAKRKNATTDKTAYKMEVTLGNDTYSEEIIVDYGNKKAQPLISSTNYINNEDLSRNMTAYVNQPKNTYTKQTFVTNLTGYKFNPNAKNFKIYEVTDQNQFVDSFTPDTSKLKDVTDQFDVIYSNDNKTATVDLMKGQTSSNKQYIIQQVAYPDNSSTDNGKIDYTLDTDKTKYSWSNSYSNVNGSSTANGDQKKYNLGDYVWEDTNKDGKQDANEK

SEQ ID NO: 165 - protein, 198 aa, Staphylococcus aureus
MSNNFKDDFEKNRQSIDTNSHQDHTEDVEKDQSELEHQDTIENTEQQFPPRNAQRRKRRRDLATNHNKQVHNESQTSEDNVQNEAGTIDDRQVESSHSTESQEPSHQDSTPQHEEEYYNKNAFAMDKSHPEPIEDNDKHDTIKNAENNTEHSTVSDKSEAEQSQQPKPYFTTGANQSETSKNEHDNDSVKQDQDEPKE

SEQ ID NO: 166 - protein, 511 aa, Staphylococcus aureus
MGQDKEAAASEQKTTTVEENGNSATDNKTSETQTTATNVNHIEETQSYNATVTEQPSNATQVTTEEAPKAVQAPQTAQPANIETVKEEVVKEEAKPQVKETTQSQDNSGDQRQVDLTPKKATQNQVAETQVEVAQPRTASESKPRVTRSADVAEAKEASNAKVETGTDVTSKVTVEIGSIEGHNNTNKVEPHAGQRAVLKYKLKFENGLHQGDYFDFTLSNNVNTHGVSTARKVPEIKNGSVVMATGEVLEGGKIRYTFTNDIEDKVDVTAELEINLFIDPKTVQTNGNQTITSTLNEEQTSKELDVKYKDGIGNYYANLNGSIETFNKANNRFSHVAFIKPNNGKTTSVTVTGTLMKGSNQNGNQPKVRIFEYLGNNEDIAKSVYANTTDTSKFKEVTSNMSGNLNLQNNGSYSLNIENLDKTYVVHYDGEYLNGTDEVDFRTQMVGHPEQLYKYYYDRGYTLTWDNGLVLYSNKANGNEKNGPIIQNNKFEYKEDTIKETLTGQYDKNL

SEQ ID NO: 167 - protein, 442 aa, Staphylococcus aureus
VTTVEEEYDSSTLDIDYHTAIDGGGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTVEDTKEYTTESNLIELVDELPEEHGQAQGPVEEITKNNHHISHSGLGTENGHGNYDVIEEIEENSHVDIKSELGYEGGQNSGNQSFEEDTEEDKPKYEQGGNIVDIDFDSVPQIHGQNKGNQSFEEDTEKDKPKYEHGGNIIDIDFDSVPHIHGFNKHTEIIEEDTNKDKPSYQFGGHNSVDFEEDTLPKVSGQNEGQQTIEEDTTPPIVPPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKKPQSKKSE

SEQ ID NO: 168 - protein, 1126 aa, Artificial Sequence
  Synthetic Construct
AENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEPSTSEIQTKPTTPQESTNIENSQPQPTPSKVDNQVTDATNPKEPVNVSKEELKNNPEKLKELVRNDSNTDHSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPASGGGSAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLSLKSQITVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKDVTDIKIYQVPKGYTLNKGYDVNTKELTDVTNQYLQKITYGDNNSAVIDFGNADSAYVVMVNTKFQYTNSESPTLVQMATLSSTGNKSVSTGNALGFTNNQSGGAGQEVYKIGNYVWEDTNKNGVQELGEKG

SEQ ID NO: 169 - DNA, 618 bp, Staphylococcus aureus
atggcaatgattaagatgagtccagaggaaatcagagcaaaatcgcaatcttacgggcaaggttcagaccaaatccgtcaaattttatctgatttaacacgtgcacaaggtgaaattgcagcgaactgggaaggtcaagctttcagccgtttcgaagagcaattccaacaacttagtcctaaagtagaaaaatttgcacaattattagaagaaattaaacaacaattgaatagcactgctgatgccgttcaagaacaagaccaacaactttctaataatttcggtttgcaagctagcggtggcggatccggtggatataaaggtattaaagcagatggtggcaaggttgatcaagcgaaacaattagcggcaaaaacagctaaagatattgaagcatgtcaaaagcaaacgcaacagctcgctgagtatatcgaaggtagtgattgggaaggacagttcgccaataaggtgaaagatgtgttactcattatggcaaagtttcaagaagaattagtacaaccgatggctgaccatcaaaaagcaattgataacttaagtcaaaatctagcgaaatacgatacattatcaattaagcaagggcttgatagggtgaaccca

SEQ ID NO: 170 - protein, 239 aa, Staphylococcus aureus
MNKNIIIKSIAALTILTSITGVGTTVVDGIQQTAKAENSVKLITNTNVAPYSGVTWMGAGTGFVVGNHTIITNKHVTYHMKVGDEIKAHPNGFYNNGGGLYKVTKIVDYPGKEDIAVVQVEEKSTQPKGRKFKDFTSKFNIASEAKENEPISVIGYPNPNGNKLQMYESTGKVLSVNGNIVTSDAVVQPGSSGSPILNSKREAIGVMYASDKPTGESTRSFAVYFSPEIKKFIADNLDK

SEQ ID NO: 171 - protein, 6 aa, Artificial Sequence
  Synthetic Construct
GSGGGG

SEQ ID NO: 172 - protein, 8 aa, Artificial Sequence
  Synthetic Construct
GSGSGGGG

SEQ ID NO: 173 - protein, 6 aa, Artificial Sequence
  Synthetic Construct
ASGGGS

SEQ ID NO: 174 - DNA, 18 bp, Artificial Sequence
  Synthetic Construct
gctagcggtggcggatcc

SEQ ID NO: 175 - DNA, 26 bp, Artificial Sequence
  Synthetic Construct
  misc_feature 1, 3, 5, 7, 9, 11, 13, 15, 17, 19, 21, 23, 25: n = Inosine
ncncncncncncncncncncncncnc

SEQ ID NO: 176 - protein, 11 aa, Artificial Sequence
  Synthetic Construct
KLKLLLLLKLK

SEQ ID NO: 177 - protein, 203 aa, Staphylococcus aureus
MFKKYDSKNSIVLKSILSLGIIYGGTFGIYPKADASTQNSSSVQDKQLQKVEEVPNNSEKALVKKLYDRYSKDTINGKSNKSRNWVYSERPLNENQVRIHLEGTYTVAGRVYTPKRNITLNKEVVTLKELDHIIRFAHISYGLYMGEHLPKGNIVINTKDGGKYTLESHKELQKDRENVKINTADIKNVTFKLVKSVNDIEQV

SEQ ID NO: 178 - protein, 146 aa, Staphylococcus aureus
MNTKYFLAAGAVITTLALGACGNSNSQDQGNKTEQKTKSEDSNVKTDKTKHLTGTFSSKNGETVEGKAEIKNGKLMLTNYKSSKGPDLYVYLTKNGDIKNGKEIAMVDYDKEKQTFDLKNVDLSKYDEVTIYCKKAHVIFGGAKLK

SEQ ID NO: 179 - protein, 619 aa, Staphylococcus aureus
MPKNKILIYLLSTTLVLPTLVSPTAYADTPQKDTTAKTTSHDSKKSNDDETSKDTTSKDIDKADKNNTSNQDNNDKKFKTIDDSTSDSNNIIDFIYKNLPQTNINQLLTKNKYDDNYSLTTLIQNLFNLNSDISDYEQPRNGEKSTNDSNKNSDNSIKNDTDTQSSKQDKADNQKAPKSNNTKPSTSNKQPNSPKPTQPNQSNSQPASDDKANQKSSSKDNQSMSDSALDSILDQYSEDAKKTQKDYASQSKKDKNEKSNTKNPQLPTQDELKHKSKPAQSFNNDVNQKDTRATSLFETDPSISNNDDSGQFNVVDSKDTRQFVKSIAKDAHRIGQDNDIYASVMIAQAILESDSGRSALAKSPNHNLFGIKGAFEGNSVPFNTLEADGNQLYSINAGFRKYPSTKESLKDYSDLIKNGIDGNRTIYKPTWKSEADSYKDATSHLSKTYATDPNYAKKLNSIIKHYQLTQFDDERMPDLDKYERSIKDYDDSSDEFKPFREVSDSMPYPHGQCTWYVYNRMKQFGTSISGDLGDAHNWNNRAQYRDYQVSHTPKRHAAVVFEAGQFGADQHYGHVAFVEKVNSDGSIVISESNVKGLGIISHRTINAAAAEELSYITGK

SEQ ID NO: 180 - protein, 208 aa, Staphylococcus aureus; identical to SEQ ID NO: 143

SEQ ID NO: 181 - protein, 105 aa, Staphylococcus aureus
MNKLLQSLSALGVSATLVTPNLNADATTNTTPQIKGANDIVIKKGQDYNLLNGISAFDKEDGDLTDKIKVDGQIDTSKSGKYQIKYHVTDSDGAIKISTRYIEVK

SEQ ID NO: 182 - protein, 312 aa, Staphylococcus aureus
MKKLVPLLLALLLLVAACGTGGKQSSDKSNGKLKVVTTNSILYDMAKNVGGDNVDIHSIVPVGQDPHEYEVKPKDIKKLTDADVILYNGLNLETGNGWFEKALEQAGKSLKDKKVIAVSKDVKPIYLNGEEGNKDKQDPHAWLSLDNGIKYVKTIQQTFIDNDKKHKADYEKQGNKYIAQLEKLNNDSKDSKDKFNDIPKEQRAMITSEGAFKYFSKQYGITPGYIWEINTEKQGTPEQMRQAIEFVKKHKLKHLLVETSVDKKAMESLSEETKKDIFGEVYTDSIGKEGTKGDSYYKMMKSNIETVHGSMK

SEQ ID NO: 183 - protein, 646 aa, Staphylococcus aureus
MSSQKKKISLFAFFLLTVITITLKTYFSYYVDFSLGVKGLVQNLILLMNPYSLVALVLSVFLFFKGKKAFWFMFIGGFLLTFLLYANVVYFRFFSDFLTFSTLNQVGNVESMGGAVSASFKWYDFVYFIDTLVYLFILIFKTKWLDTKAFSKKFVPVVMAASVALFFLNLAFAETDRPELLTRTFDHKYLVKYLGPYNFTVYDGVKTIENNQQKALASEDDLTKVLNYTKQRQTEPNPEYYGVAKKKNIIKIHLESFQTFLINKKVNGKEVTPFLNKLSSGKEQFTYFPNFFHQTGQGKTSDSEFTMDNSLYGLPQGSAFSLKGDNTYQSLPAILDQKQGYKSDVMHGDYKTFWNRDQVYKHFGIDKFYDATYYDMSDKNVVNLGLKDKIFFKDSANYQAKMKSPFYSHLITLTNHYPFTLDEKDATIEKSNTGDATVDGYIQTARYLDEALEEYINDLKKKGLYDNSVIMIYGDHYGISENHNNAMEKLLGEKITPAKFTDLNRTGFWIKIPGKSGGINNEYAGQVDVMPTILHLAGIDTKNYLMFGTDLFSKGHNQVVPFRNGDFITKDYKYVNGKIYSNKNNELITTQPADFEKNKKQVEKDLEMSDNVLNGDLFRFYKNPDFKKVNPSKYKYETGPKANSKK

SEQ ID NO: 184 - protein, 173 aa, Staphylococcus aureus
MINIISAIGSIGTFIMALFYFVSVSVQLYQMKISFLPALGFNQILLEREEDQLNIMNSATEEHHHKDYIKLYNLGGGAAKKIAIEVLLGKDKVIQKKYVHILPSKEGYMLPINKNVYEELERTIENNGHEADLNVRMTYYHNVSRKQQEVILKGQIDRFNTYNNKEIYDLQFI

SEQ ID NO: 185 - protein, 156 aa, Staphylococcus aureus
MKRKVLVLTMGVICATQLWHSNHANALVTESGANDTKQFTEIVSEEKVITVEHAQINIFQSNSNSNLMEFNILTMGGKSGAMVGYSEIDSSHFTDRDKRVIRRDHVKEAQSLVENYKDTQSADARMKAKQKVNTLSKPHQNYFNKQIDKVYNGLQR

SEQ ID NO: 186 - protein, 133 aa, Staphylococcus aureus
MKKNITKTIIASTVIAAGLLTQTNDAKAFFSYEWKGLEIAKNLADQAKKDDERIDKLMKESDKNLTPYKAETVNDLYLIVKKLSQGDVKKAVVRIKDGGPRDYYTFDLTRPLEENRKNIKVVKNGEIDSITWY

SEQ ID NO: 187 - protein, 274 aa, Staphylococcus aureus
MYPNWGQYKRADLIGQSSYIKNNDVVIFNEAFDNGASDKLLSNVKKEYPYQTPVLGRSQSGWDKTEGSYSSTVAEDGGVAIVSKYPIKEKIQHVFKSGCGFDNDSNKGFVYTKIEKNGKNVHVIGTHTQSEDSRCGAGHDRKIRAEQMKEISDFVKKKNIPKDETVYIGGDLNVNKGTPEFKDMLKNLNVNDVLYAGHNSTWDPQSNSIAKYNYPNGKPEHLDYIFTDKDHKQPKQLVNEVVTEKPKPWDVYAFPYYYVYNDFSDHYPIKAYSK

SEQ ID NO: 188 - protein, 390 aa, Staphylococcus aureus
MLEFEQGFNHLATLKVIGVGGGGNNAVNRMIDHGMNNVEFIAINTDGQALNLSKAESKIQIGEKLTRGLGAGANPEIGKKAAEESREQIEDAIQGADMVFVTSGMGGGTGTGAAPVVAKIAKEMGALTVGVVTRPFSFEGRKRQTQAAAGVEAMKAAVDTLIVIPNDRLLDIVDKSTPMMEAFKEADNVLRQGVQGISDLIAVSGEVNLDFADVKTIMSNQGSALMGIGVSSGENRAVEAAKKAISSPLLETSIVGAQGVLMNITGGESLSLFEAQEAADIVQDAADEDVNMIFGTVINPELQDEIVVTVIATGFDDKPTSHGRKSGSTGFGTSVNTSSNATSKDESFTSNSSNAQATDSVSERTHTTKEDDIPSFIRNREERRSRRTRR

SEQ ID NO: 189 - protein, 258 aa, Artificial Sequence
  Synthetic Construct
ADSDINIKTGTTDIGSNTTVKTGDLVTYDKENGMLKKVFYSFIDDKNHNKKLLVIRTKGTIAGQYRVYSEEGANKSGLAWPSAFKVQLQLPDNEVAQISDYYPRNSIDTPSGSVQPDFKTILESPTDKKVGWKVIFNNMVNQNWGPYDRDSWNPVYGNQLFMKTRNGSMKAADNFLDPNKASSLLSSGFSPDFATVITMDRKASKQQTNIDVIYERVRDDYQLHWTSTNWKGTNTKDKWIDRSSERYKIDWEKEEMTN

SEQ ID NO: 190 - protein, 306 aa, Staphylococcus aureus
KFVVPESGINKIIPAYDEFKNSPKVNVSNLTDNKNFVASEDKLNKIADSSAASKIVDKNFVVPESKLGNIVPEYKEINNRVNVATNNPASQQVDKHFVAKGPEVNRFITQNKVNHHFITTQTHYKKVITSYKSTHVHKHVNHAKDSINKHFIVKPSESPRYTHPSQSLIIKHHFAVPGYHAHKFVTPGHASIKINHFCVVPQINSFKVIPPYGHNSHRMHVPSFQNNTTATHQNAKVNKAYDYKYFYSYKVVKGVKKYFSFSQSNGYKIGKPSLNIKNVNYQYAVPSYSPTHYVPEFKGSLPAPRV

SEQ ID NO: 191 - protein, 308 aa, Staphylococcus aureus
SVTESVDKKFVVPESGINKIIPAYDEFKNSPKVNVSNLTDNKNFVASEDKLNKIADSSAASKIVDKNFVVPESKLGNIVPEYKEINNRVNVATNNPASQQVDKHFVAKGPEVNRFITQNKVNHHFITTQTHYKKVITSYKSTHVHKHVNHAKDSINKHFIVKPSESPRYTHPSQSLIIKHHFAVPGYHAHKFVTPGHASIKINHFCVVPQINSFKVIPPYGHNSHRMHVPSFQNNTTATHQNAKVNKAYDYKYFYSYKVVKGVKKYFSFSQSNGYKIGKPSLNIKNVNYQYAVPSYSPTHYVPEFKGS

SEQ ID NO: 192 - protein, 300 aa, Staphylococcus aureus
KFVVPESGINKIIPAYDEFKNSPKVNVSNLTDNKNFVASEDKLNKIADSSAASKIVDKNFVVPESKLGNIVPEYKEINNRVNVATNNPASQQVDKHFVAKGPEVNRFITQNKVNHHFITTQTHYKKVITSYKSTHVHKHVNHAKDSINKHFIVKPSESPRYTHPSQSLIIKHHFAVPGYHAHKFVTPGHASIKINHFCVVPQINSFKVIPPYGHNSHRMHVPSFQNNTTATHQNAKVNKAYDYKYFYSYKVVKGVKKYFSFSQSNGYKIGKPSLNIKNVNYQYAVPSYSPTHYVPEFKGS

SEQ ID NO: 193 - protein, 121 aa, Staphylococcus aureus
SVTESVDKKFVVPESGINKIIPAYDEFKNSPKVNVSNLTDNKNFVASEDKLNKIADSSAASKIVDKNFVVPESKLGNIVPEYKEINNRVNVATNNPASQQVDKHFVAKGPEVNRFITQNKV

SEQ ID NO: 194 - protein, 53 aa, Staphylococcus aureus
ADSDINIKTGTTDIGSNTTVKTGDLVTYDKENGMHKKVFYSFIDDKNHNKKLL

SEQ ID NO: 195 - protein, 53 aa, Staphylococcus aureus
ADSDINIKTGTTDIGSNTTVKTGDLVTYDKENGMLKKVFYSFIDDKNHNKKLL

SEQ ID NO: 196 - protein, 316 aa, Staphylococcus aureus
SEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYS

SEQ ID NO: 197 - protein, 331 aa, Staphylococcus aureus
GTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVN

SEQ ID NO: 198 - protein, 183 aa, Staphylococcus aureus
SSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVN

SEQ ID NO: 199 - protein, 199 aa, Staphylococcus aureus
PDYVVNEKNSIGSAFTETVSHVGNKENPGYYKQTIYVNPSENSLTNAKLKVQAYHSSYPNNIGQINKDVTDIKIYQVPKGYTLNKGYDVNTKELTDVTNQYLQKITYGDNNSAVIDFGNADSAYVVMVNTKFQYTNSESPTLVQMATLSSTGNKSVSTGNALGFTNNQSGGAGQEVYKIGNYVWEDTNKNGVQELGEKG

SEQ ID NO: 200 - protein, 104 aa, Staphylococcus aureus
MAIVKVTDADFDSKVESGVQLVDFWATWCGPCKMIAPVLEELAADYEGKADILKLDVDENPSTAAKYEVMSIPTLIVFKDGQPVDKVVGFQPKENLAEVLDKHL

SEQ ID NO: 201 - protein, 189 aa, Staphylococcus aureus
MSLINKEILPFTAQAFDPKKDQFKEVTQEDLKGSWSVVCFYPADFSFVCPTELEDLQNQYEELQKLGVNVFSVSTDTHFVHKAWHDHSDAISKITYTMIGDPSQTITRNFDVLDEATGLAQRGTFIIDPDGVVQASEINADGIGRDASTLAHKIKAAQYVRKNPGEVCPAKWEEGAKTLQPGLDLVGKI

SEQ ID NO: 202 - protein, 1054 aa, Artificial Sequence
  Synthetic Construct
SEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVASGGGSAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLSLKSQITVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKDVTDIKIYQVPKGYTLNKGYDVNTKELTDVTNQYLQKITYGDNNSAVIDFGNADSAYVVMVNTKFQYTNSESPTLVQMATLSSTGNKSVSTGNALGFTNNQSGGAGQEVYKIGNYVWEDTNKNGVQELGEKG

SEQ ID NO: 203 - protein, 1054 aa, Artificial Sequence
  Synthetic Construct
AESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLSLKSQITVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKDVTDIKIYQVPKGYTLNKGYDVNTKELTDVTNQYLQKITYGDNNSAVIDFGNADSAYVVMVNTKFQYTNSESPTLVQMATLSSTGNKSVSTGNALGFTNNQSGGAGQEVYKIGNYVWEDTNKNGVQELGEKGASGGGSSEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPV

SEQ ID NO: 204 - protein, 376 aa, Artificial Sequence
  Synthetic Construct
DSQQVNAATEATNATNNQSTQVSQATSQPINFQVQKDGSSEKSHMDDYMQHPGKVIKQNNKYYFQTVLNNASFWKEYKFYNANNQELATTVVNDNKKADTRTINVAVEPGYKSLTTKVHIVVPQINYNHRYTTHLEFEKAIPTLADAAKPNNVKPVQPKPAQPKTPTEQTKPVQPKVEKVKPTVTTTSKVEDNHSTKVVSTDTTKDQTKTQTAHTVKTAQTAQEQNKVQTPVKDVATAKSESNNQAVSDNKSQQTNKVTKHNETPKQASKAKEASGGGSMAMIKMSPEEIRAKSQSYGQGSDQIRQILSDLTRAQGEIAANWEGQAFSRFEEQFQQLSPKVEKFAQLLEEIKQQLNSTADAVQEQDQQLSNNFGLQ

SEQ ID NO: 205 - protein, 613 aa, Artificial Sequence
  Synthetic Construct
ADSDINIKTGTTDIGSNTTVKTGDLVTYDKENGMLKKVFYSFIDDKNHNKKLLVIRTKGTIAGQYRVYSEEGANKSGLAWPSAFKVQLQLPDNEVAQISDYYPRNSIDTKEYMSTLTYGFNGNVTGDDTGKIGGLIGANVSIGHTLKYVQPDFKTILESPTDKKVGWKVIFNNMVNQNWGPYDRDSWNPVYGNQLFMKTRNGSMKAADNFLDPNKASSLLSSGFSPDFATVITMDRKASKQQTNIDVIYERVRDDYQLHWTSTNWKGTNTKDKWIDRSSERYKIDWEKEEMTNASGGGSSVTESVDKKFVVPESGINKIIPAYDEFKNSPKVNVSNLTDNKNFVASEDKLNKIADSSAASKIVDKNFVVPESKLGNIVPEYKEINNRVNVATNNPASQQVDKHFVAKGPEVNRFITQNKVNHHFITTQTHYKKVITSYKSTHVHKHVNHAKDSINKHFIVKPSESPRYTHPSQSLIIKHHFAVPGYHAHKFVTPGHASIKINHFCVVPQINSFKVIPPYGHNSHRMHVPSFQNNTTATHQNAKVNKAYDYKYFYSYKVVKGVKKYFSFSQSNGYKIGKPSLNIKNVNYQYAVPSYSPTHYVPEFKGSLPAPRV

SEQ ID NO: 206 - protein, 370 aa, Artificial Sequence
  Synthetic Construct
ADSDINIKTGTTDIGSNTTVKTGDLVTYDKENGMHKKVFYSFIDDKNHNKASGGGSSVTESVDKKFVVPESGINKIIPAYDEFKNSPKVNVSNLTDNKNFVASEDKLNKIADSSAASKIVDKNFVVPESKLGNIVPEYKEINNRVNVATNNPASQQVDKHFVAKGPEVNRFITQNKVNHHFITTQTHYKKVITSYKSTHVHKHVNHAKDSINKHFIVKPSESPRYTHPSQSLIIKHHFAVPGYHAHKFVTPGHASIKINHFCVVPQINSFKVIPPYGHNSHRMHVPSFQNNTTATHQNAKVNKAYDYKYFYSYKVVKGVKKYFSFSQSNGYKIGKPSLNIKNVNYQYAVPSYSPTHYVPEFKGSLPAPRV

SEQ ID NO: 207 - protein, 370 aa, Artificial Sequence
  Synthetic Construct
ADSDINIKTGTTDIGSNTTVKTGDLVTYDKENGMLKKVFYSFIDDKNHNKASGGGSSVTESVDKKFVVPESGINKIIPAYDEFKNSPKVNVSNLTDNKNFVASEDKLNKIADSSAASKIVDKNFVVPESKLGNIVPEYKEINNRVNVATNNPASQQVDKHFVAKGPEVNRFITQNKVNHHFITTQTHYKKVITSYKSTHVHKHVNHAKDSINKHFIVKPSESPRYTHPSQSLIIKHHFAVPGYHAHKFVTPGHASIKINHFCVVPQINSFKVIPPYGHNSHRMHVPSFQNNTTATHQNAKVNKAYDYKYFYSYKVVKGVKKYFSFSQSNGYKIGKPSLNIKNVNYQYAVPSYSPTHYVPEFKGSLPAPRV

SEQ ID NO: 208 - protein, 578 aa, Artificial Sequence
  Synthetic Construct
ADSDINIKTGTTDIGSNTTVKTGDLVTYDKENGMLKKVFYSFIDDKNHNKKLLVIRTKGTIAGQYRVYSEEGANKSGLAWPSAFKVQLQLPDNEVAQISDYYPRNSIDTPSGSVQPDFKTILESPTDKKVGWKVIFNNMVNQNWGPYDRDSWNPVYGNQLFMKTRNGSMKAADNFLDPNKASSLLSSGFSPDFATVITMDRKASKQQTNIDVIYERVRDDYQLHWTSTNWKGTNTKDKWIDRSSERYKIDWEKEEMTNASGGGSSVTESVDKKFVVPESGINKIIPAYDEFKNSPKVNVSNLTDNKNFVASEDKLNKIADSSAASKIVDKNFVVPESKLGNIVPEYKEINNRVNVATNNPASQQVDKHFVAKGPEVNRFITQNKVNHHFITTQTHYKKVITSYKSTHVHKHVNHAKDSINKHFIVKPSESPRYTHPSQSLIIKHHFAVPGYHAHKFVTPGHASIKINHFCVVPQINSFKVIPPYGHNSHRMHVPSFQNNTTATHQNAKVNKAYDYKYFYSYKVVKGVKKYFSFSQSNGYKIGKPSLNIKNVNYQYAVPSYSPTHYVPEFKGSLPAPRV

SEQ ID NO: 209 - protein, 248 aa, Artificial Sequence
  Synthetic Construct
DSQQVNAATEATNATNNQSTQVSQATSQPINFQVQKDGSSEKSHMDDYMQHPGKVIKQNNKYYFQTVLNNASFWKEYKFYNANNQELATTVVNDNKKADTRTINVAVEPGYKSLTTKVHIVVPQINYNHRYTTHLEFEKAIPTLAASGGGSMAMIKMSPEEIRAKSQSYGQGSDQIRQILSDLTRAQGEIAANWEGQAFSRFEEQFQQLSPKVEKFAQLLEEIKQQLNSTADAVQEQDQQLSNNFGLQ

SEQ ID NO: 210 - protein, 358 aa, Artificial Sequence
  Synthetic Construct
DSQQVNAATEATNATNNQSTQVSQATSQPINFQVQKDGSSEKSHMDDYMQHPGKVIKQNNKYYFQTVLNNASFWKEYKFYNANNQELATTVVNDNKKADTRTINVAVEPGYKSLTTKVHIVVPQINYNHRYTTHLEFEKAIPTLAASGGGSMAMIKMSPEEIRAKSQSYGQGSDQIRQILSDLTRAQGEIAANWEGQAFSRFEEQFQQLSPKVEKFAQLLEEIKQQLNSTADAVQEQDQQLSNNFGLQASGGGSMGGYKGIKADGGKVDQAKQLAAKTAKDIEACQKQTQQLAEYIEGSDWEGQFANKVKDVLLIMAKFQEELVQPMADHQKAIDNLSQNLAKYDTLSIKQGLDRVNP

SEQ ID NO: 211 - protein, 388 aa, Artificial Sequence
  Synthetic Construct
SSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNASGGGSPDYVVNEKNSIGSAFTETVSHVGNKENPGYYKQTIYVNPSENSLTNAKLKVQAYHSSYPNNIGQINKDVTDIKIYQVPKGYTLNKGYDVNTKELTDVTNQYLQKITYGDNNSAVIDFGNADSAYVVMVNTKFQYTNSESPTLVQMATLSSTGNKSVSTGNALGFTNNQSGGAGQEVYKIGNYVWEDTNKNGVQELGEKG

SEQ ID NO: 212 - protein, 486 aa, Artificial Sequence
  Synthetic Construct
DSQQVNAATEATNATNNQSTQVSQATSQPINFQVQKDGSSEKSHMDDYMQHPGKVIKQNNKYYFQTVLNNASFWKEYKFYNANNQELATTVVNDNKKADTRTINVAVEPGYKSLTTKVHIVVPQINYNHRYTTHLEFEKAIPTLADAAKPNNVKPVQPKPAQPKTPTEQTKPVQPKVEKVKPTVTTTSKVEDNHSTKVVSTDTTKDQTKTQTAHTVKTAQTAQEQNKVQTPVKDVATAKSESNNQAVSDNKSQQTNKVTKHNETPKQASKAKEASGGGSMAMIKMSPEEIRAKSQSYGQGSDQIRQILSDLTRAQGEIAANWEGQAFSRFEEQFQQLSPKVEKFAQLLEEIKQQLNSTADAVQEQDQQLSNNFGLQASGGGSMGGYKGIKADGGKVDQAKQLAAKTAKDIEACQKQTQQLAEYIEGSDWEGQFANKVKDVLLIMAKFQEELVQPMADHQKAIDNLSQNLAKYDTLSIKQGLDRVNP

SEQ ID NO: 213 - protein, 256 aa, Staphylococcus aureus
MMKRLNKLVLGIIFLFLVISITAGCGIGKEAEVKKSFEKTLSMYPIKNLEDLYDKEGYRDDQFDKNDKGTWIINSEMVIQPNNEDMVAKGMVLYMNRNTKTTNGYYYVDVTKDEDEGKPHDNEKRYPVKMVDNKIIPTKEIKDEKLKKEIENFKFFVQYGDFKNIKNYKDGDISYNPEVPSYSAKYQLTNDDYNVKQLRKRYDIPTSKAPKLLLKGSGNLKGSSVGYKDIEFTFVEKKEENIYFSDSLDYKKSGDV

SEQ ID NO: 214 - protein, 256 aa, Staphylococcus aureus
MMKRLNKLVLGIIFLFLVISITAGCGIGKEAEVKKSFEKTLSMYPIKNLEDLYDKEGYRDDQFDKNDKGTWIINSEMVIQPNNEDMVAKGMVLYMNRNTKTTNGYYYVDVTKDEDEGKPHDNEKRYPVKMVDNKIIPTKEIKDEKVKKEIENFKFFVQYGDFKNIKNYKDGDISYNPEVPSYSAKYQLTNDDYNVKQLRKRYDIPTSKAPKLLLKGSGNLKGSSVGYKDIEFTFVEKKEENIYFSDSLDYKKSGDV

SEQ ID NO: 215 - protein, 256 aa, Staphylococcus aureus
MMKRLNKLVLGIIFLFLVISITAGCGIGKEAEVKKSFEKTLSMYPIKNLEDLYDKEGYRDDQFDKNDKGTWIINSEMVIQPNNEDMVAKGMVLYMNRNTKTTNGYYYVDVTKDEDEGKPHDNEKRYPVKMVDNKIIPTKEIKDEKLKKEIENFKFFVQYGDFKNVKNYKDGDISYNPEVPSYSAKYQLTNDDYNVKQLRKRYDIPTSKAPKLLLKGSGNLKGSSVGYKDIEFTFVEKKEENIYFSDSLDYKKSGDV

SEQ ID NO: 216 - protein, 258 aa, Artificial Sequence
  Synthetic Construct
ADSDINIKTGTTDIGSNTTVKTGDLVTYDKENGMHKKVFYSFIDDKNHNKKLLVIRTKGTIAGQYRVYSEEGANKSGLAWPSAFKVQLQLPDNEVAQISDYYPRNSIDTPSGSVQPDFKTILESPTDKKVGWKVIFNNMVNQNWGPYDRDSWNPVYGNQLFMKTRNGSMKAADNFLDPNKASSLLSSGFSPDFATVITMDRKASKQQTNIDVIYERVRDDYQLHWTSTNWKGTNTKDKWIDRSSERYKIDWEKEEMTN

SEQ ID NO: 217 - protein, 40 aa, Staphylococcus aureus
KEYMSTLTYGFNGNVTGDDTGKIGGLIGANVSIGHTLKYV

SEQ ID NO: 218 - protein, 109 aa, Staphylococcus aureus
ADSDINIKTGTTDIGSNTTVKTGDLVTYDKENGMHKKVFYSFIDDKNHNKKLLVIRTKGTIAGQYRVYSEEGANKSGLAWPSAFKVQLQLPDNEVAQISDYYPRNSIDT

SEQ ID NO: 219 - protein, 145 aa, Staphylococcus aureus
VQPDFKTILESPTDKKVGWKVIFNNMVNQNWGPYDRDSWNPVYGNQLFMKTRNGSMKAADNFLDPNKASSLLSSGFSPDFATVITMDRKASKQQTNIDVIYERVRDDYQLHWTSTNWKGTNTKDKWIDRSSERYKIDWEKEEMTN

SEQ ID NO: 220 - protein, 506 aa, Artificial Sequence
  Synthetic Construct
ADSDINIKTGTTDIGSNTTVKTGDLVTYDKENGMLKKVFYSFIDDKNHNKKLLVIRTKGTIAGQYRVYSEEGANKSGLAWPSAFKVQLQLPDNEVAQISDYYPRNSIDTKEYMSTLTYGFNGNVTGDDTGKIGGLIGANVSIGHTLKYVQPDFKTILESPTDKKVGWKVIFNNMVNQNWGPYDRDSWNPVYGNQLFMKTRNGSMKAADNFLDPNKASSLLSSGFSPDFATVITMDRKASKQQTNIDVIYERVRDDYQLHWTSTNWKGTNTKDKWIDRSSERYKIDWEKEEMTNASGGGSMAMIKMSPEEIRAKSQSYGQGSDQIRQILSDLTRAQGEIAANWEGQAFSRFEEQFQQLSPKVEKFAQLLEEIKQQLNSTADAVQEQDQQLSNNFGLQASGGGSMGGYKGIKADGGKVDQAKQLAAKTAKDIEACQKQTQQLAEYIEGSDWEGQFANKVKDVLLIMAKFQEELVQPMADHQKAIDNLSQNLAKYDTLSIKQGLDRVNP

SEQ ID NO: 221 - protein, 436 aa, Artificial Sequence
  Synthetic Construct
DSQQVNAATEATNATNNQSTQVSQATSQPINFQVQKDGSSEKSHMDDYMQHPGKVIKQNNKYYFQTVLNNASFWKEYKFYNANNQELATTVVNDNKKADTRTINVAVEPGYKSLTTKVHIVVPQINYNHRYTTHLEFEKAIPTLAASGGGSCGNQGEKNNKAETKSYKMDDGKTVDIPKDPKRIAVVAPTYAGGLKKLGANIVAVNQQVDQSKVLKDKFKGVTKIGDGDVEKVAKEKPDLIIVYSTDKDIKKYQKVAPTVVVDYNKHKYLEQQEMLGKIVGKEDKVKAWKKDWEETTAKDGKEIKKAIGQDATVSLFDEFDKKLYTYGDNWGRGGEVLYQAFGLKMQPEQQKLTAKAGWAEVKQEEIEKYAGDYIVSTSEGKPTPGYESTNMWKNLKATKEGHIVKVDAGTYWYNDPYTLDFMRKDLKEKLIKAAK

SEQ ID NO: 222 - protein, 584 aa, Artificial Sequence
  Synthetic Construct
ADSDINIKTGTTDIGSNTTVKTGDLVTYDKENGMLKKVFYSFIDDKNHNKKLLVIRTKGTIAGQYRVYSEEGANKSGLAWPSAFKVQLQLPDNEVAQISDYYPRNSIDTKEYMSTLTYGFNGNVTGDDTGKIGGLIGANVSIGHTLKYVQPDFKTILESPTDKKVGWKVIFNNMVNQNWGPYDRDSWNPVYGNQLFMKTRNGSMKAADNFLDPNKASSLLSSGFSPDFATVITMDRKASKQQTNIDVIYERVRDDYQLHWTSTNWKGTNTKDKWIDRSSERYKIDWEKEEMTNASGGGSCGNQGEKNNKAETKSYKMDDGKTVDIPKDPKRIAVVAPTYAGGLKKLGANIVAVNQQVDQSKVLKDKFKGVTKIGDGDVEKVAKEKPDLIIVYSTDKDIKKYQKVAPTVVVDYNKHKYLEQQEMLGKIVGKEDKVKAWKKDWEETTAKDGKEIKKAIGQDATVSLFDEFDKKLYTYGDNWGRGGEVLYQAFGLKMQPEQQKLTAKAGWAEVKQEEIEKYAGDYIVSTSEGKPTPGYESTNMWKNLKATKEGHIVKVDAGTYWYNDPYTLDFMRKDLKEKLIKAAK

SEQ ID NO: 223 - protein, 498 aa, Artificial Sequence
  Synthetic Construct
CGNQGEKNNKAETKSYKMDDGKTVDIPKDPKRIAVVAPTYAGGLKKLGANIVAVNQQVDQSKVLKDKFKGVTKIGDGDVEKVAKEKPDLIIVYSTDKDIKKYQKVAPTVVVDYNKHKYLEQQEMLGKIVGKEDKVKAWKKDWEETTAKDGKEIKKAIGQDATVSLFDEFDKKLYTYGDNWGRGGEVLYQAFGLKMQPEQQKLTAKAGWAEVKQEEIEKYAGDYIVSTSEGKPTPGYESTNMWKNLKATKEGHIVKVDAGTYWYNDPYTLDFMRKDLKEKLIKAAKASGGGSMAMIKMSPEEIRAKSQSYGQGSDQIRQILSDLTRAQGEIAANWEGQAFSRFEEQFQQLSPKVEKFAQLLEEIKQQLNSTADAVQEQDQQLSNNFGLQASGGGSMGGYKGIKADGGKVDQAKQLAAKTAKDIEACQKQTQQLAEYIEGSDWEGQFANKVKDVLLIMAKFQEELVQPMADHQKAIDNLSQNLAKYDTLSIKQGLDRVNP

SEQ ID NO: 224 - protein, 520 aa, Staphylococcus aureus
SENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPVAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYIDPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPE

SEQ ID NO: 225 - protein, 4 aa, Artificial Sequence
  Synthetic Construct
PSGS

SEQ ID NO: 226 - protein, 6 aa, Artificial Sequence
  Synthetic Construct
HHHHHH

SEQ ID NO: 227 - protein, 4 aa, Artificial Sequence
  Synthetic Construct
GGGG

SEQ ID NO: 228 - protein, 20 aa, Staphylococcus aureus
MSGGIGNQYAVDPTSYLQSR

SEQ ID NO: 229 - protein, 23 aa, Staphylococcus aureus
AGDQIAYSGSTGNSTAPHVHFQR

SEQ ID NO: 230 - protein, 4 aa, Artificial Sequence
  Synthetic Construct
GSGS

SEQ ID NO: 231 - protein, 293 aa, Staphylococcus aureus
ADSDINIKTGTTDIGSNTTVKTGDLVTYDKENGMHKKVFYSFIDDKNHNKKLLVIRTKGTIAGQYRVYSEEGANKSGLAWPSAFKVQLQLPDNEVAQISDYYPRNSIDTKEYMSTLTYGFNGNVTGDDTGKIGGLIGANVSIGHTLKYVQPDFKTILESPTDKKVGWKVIFNNMVNQNWGPYDRDSWNPVYGNQLFMKTRNGSMKAADNFLDPNKASSLLSSGFSPDFATVITMDRKASKQQTNIDVIYERVRDDYQLHWTSTNWKGTNTKDKWIDRSSERYKIDWEKEEMTN

SEQ ID NO: 232 - protein, 296 aa, Staphylococcus aureus
MASADSDINIKTGTTDIGSNTTVKTGDLVTYDKENGMLKKVFYSFIDDKNHNKKLLVIRTKGTIAGQYRVYSEEGANKSGLAWPSAFKVQLQLPDNEVAQISDYYPRNSIDTKEYMSTLTYGFNGNVTGDDTGKIGGLIGANVSIGHTLKYVQPDFKTILESPTDKKVGWKVIFNNMVNQNWGPYDRDSWNPVYGNQLFMKTRNGSMKAADNFLDPNKASSLLSSGFSPDFATVITMDRKASKQQTNIDVIYERVRDDYQLHWTSTNWKGTNTKDKWIDRSSERYKIDWEKEEMTN

SEQ ID NO: 233 - DNA, 888 bp, Staphylococcus aureus
atggctagcgcagattctgatattaatattaaaaccggtactacagatattggaagcaatactacagtaaaaacaggtgatttagtcacttatgataaagaaaatggcatgttaaaaaaagtattttatagttttatcgatgataaaaatcataataaaaaactgctagttattagaacgaaaggtaccattgctggtcaatatagagtttatagcgaagaaggtgctaacaaaagtggtttagcctggccttcagcctttaaggtacagttgcaactacctgataatgaagtagctcaaatatctgattactatccaagaaattcgattgatacaaaagagtatatgagtactttaacttatggattcaacggtaatgttactggtgatgatacaggaaaaattggcggccttattggtgcaaatgtttcgattggtcatacactgaaatatgttcaacctgatttcaaaacaattttagagagcccaactgataaaaaagtaggctggaaagtgatatttaacaatatggtgaatcaaaattggggaccatatgatagagattcttggaacccggtatatggcaatcaacttttcatgaaaactagaaatggctctatgaaagcagcagataacttccttgatcctaacaaagcaagttctctattatcttcagggttttcaccagacttcgctacagttattactatggatagaaaagcatccaaacaacaaacaaatatagatgtaatatacgaacgagttcgtgatgactaccaattgcactggacttcaacaaattggaaaggtaccaatactaaagataaatggatagatcgttcttcagaaagatataaaatcgattgggaaaaagaagaaatgacaaat

SEQ ID NO: 234 - protein, 306 aa, Staphylococcus aureus
MKKLLLPLIALILVLAACGNNSDSGSKDSDKKAETKSYKTDDGKTIKVPKNPKRIAVVAPSYAGGIKKLGGNVVAVSNQVDQSSILKDKFKGVTKVGDDDVEKVAKQKPDLIIVLDQNKNIKKYKKIAATVPFNYQKHKYLEQQEELGKLLGKEDEVKKWEKQWKDQTAKDGKEIKNKIGADSTVSIFDEFDKKLYTYGDNWGRGGEVLYQAFGLKMSKGQHDLTKKAGWAEVNQEQIEKVAGDYIVSTSAGKSTPGYEKTNIWKNLPAVKKGHVIKVKAETFWYNDPYTLDFMRKDLKKKLMDAK

SEQ ID NO: 235 - protein, 253 aa, Staphylococcus aureus
MRYLKKVTIYISLLILVSGCGNGKETEIKQNFNKMLDMYPTKNLEDFYDKEGYRDEEFDKKDKGTWIVGSTMTIEPKGKYMESRGMFLYINRNTRTTKGYYYVRKTTDDSKGRLKDDEKRYPVKMEHNKIIPTKPIPNDKLKKEIENFKFFVQYGDFKNLKDYKDGDISYNPNVPSYSAKYQLSNNDYNVKQLRKRYDIPTNQAPKLLLKGDGDLKGSSIGSKSLEFTFIENKEENIFFSDGVQFTPSEDSES

SEQ ID NO: 236 - protein, 531 aa, Staphylococcus aureus
VGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYCFDNLDSGKYKVIFEKPAGLTQTVTNTTEDDKDADGGEVDVTITDHDDFTLDNGYFEEDT

SEQ ID NO: 237 - protein, 504 aa, Artificial Sequence
  Synthetic Construct
ADSDINIKTGTTDIGSNTTVKTGDLVTYDKENGMLKKVFYSFIDDKNHNKKLLVIRTKGTIAGQYRVYSEEGANKSGLAWPSAFKVQLQLPDNEVAQISDYYPRNSIDTKEYMSTLTYGFNGNVTGDDTGKIGGLIGANVSIGHTLKYVQPDFKTILESPTDKKVGWKVIFNNMVNQNWGPYDRDSWNPVYGNQLFMKTRNGSMKAADNFLDPNKASSLLSSGFSPDFATVITMDRKASKQQTNIDVIYERVRDDYQLHWTSTNWKGTNTKDKWIDRSSERYKIDWEKEEMTNAPTARGAMIKMSPEEIRAKSQSYGQGSDQIRQILSDLTRAQGEIAANWEGQAFSRFEEQFQQLSPKVEKFAQLLEEIKQQLNSTADAVQEQDQQLSNNFGLQASGGGSGGYKGIKADGGKVDQAKQLAAKTAKDIEACQKQTQQLAEYIEGSDWEGQFANKVKDVLLIMAKFQEELVQPMADHQKAIDNLSQNLAKYDTLSIKQGLDRVNP

SEQ ID NO: 238 - protein, 496 aa, Artificial Sequence
  Synthetic Construct
CGNQGEKNNKAETKSYKMDDGKTVDIPKDPKRIAVVAPTYAGGLKKLGANIVAVNQQVDQSKVLKDKFKGVTKIGDGDVEKVAKEKPDLIIVYSTDKDIKKYQKVAPTVVVDYNKHKYLEQQEMLGKIVGKEDKVKAWKKDWEETTAKDGKEIKKAIGQDATVSLFDEFDKKLYTYGDNWGRGGEVLYQAFGLKMQPEQQKLTAKAGWAEVKQEEIEKYAGDYIVSTSEGKPTPGYESTNMWKNLKATKEGHIVKVDAGTYWYNDPYTLDFMRKDLKEKLIKAAKAPTARGAMIKMSPEEIRAKSQSYGQGSDQIRQILSDLTRAQGEIAANWEGQAFSRFEEQFQQLSPKVEKFAQLLEEIKQQLNSTADAVQEQDQQLSNNFGLQASGGGSGGYKGIKADGGKVDQAKQLAAKTAKDIEACQKQTQQLAEYIEGSDWEGQFANKVKDVLLIMAKFQEELVQPMADHQKAIDNLSQNLAKYDTLSIKQGLDRVNP

SEQ ID NO: 239 - protein, 6 aa, Artificial Sequence
  Synthetic Construct
APTARG

SEQ ID NO: 240 - protein, 17 aa, Staphylococcus aureus
MGSSHHHHHHENLYFQG

SEQ ID NO: 241 - protein, 205 aa, Staphylococcus aureus
AMIKMSPEEIRAKSQSYGQGSDQIRQILSDLTRAQGEIAANWEGQAFSRFEEQFQQLSPKVEKFAQLLEEIKQQLNSTADAVQEQDQQLSNNFGLQASGGGSGGYKGIKADGGKVDQAKQLAAKTAKDIEACQKQTQQLAEYIEGSDWEGQFANKVKDVLLIMAKFQEELVQPMADHQKAIDNLSQNLAKYDTLSIKQGLDRVNP

SEQ ID NO: 242 - protein, 293 aa, Staphylococcus aureus
ADSDINIKTGTTDIGSNTTVKTGDLVTYDKENGMHKKVFYSFIDDKNHNKKLLVIRTKGTIAGQYRVYSEEGANKSGLAWPSAFKVQLQLPDNEVAQISDLYPRNSIDTKEYMSTLTYGFNGNVTGDDTGKIGGLIGANVSIGHTLKYVQPDFKTILESPTDKKVGWKVIFNNMVNQNWGPYDRDSWNPVYGNQLFMKTRNGSMKAADNFLDPNKASSLLSSGFSPDFATVITMDRKASKQQTNIDVIYERVRDDYQLHWTSTNWKGTNTKDKWIDRSSERYKIDWEKEEMTN

SEQ ID NO: 243 - protein, 293 aa, Staphylococcus aureus
ADSDINIKTGTTDIGSNTTVKTGDLVTYDKENGMHKKVFYSFIDDKNHNKKLLVIRTKGTIAGQYRVYSEEGANKSGLAWPSAFKVQLQLPDNEVAQISDYYPRNSIDTKEYMSTLTYGFNGNVTGDDTGKIGGLIGANVSIGHTLKYVQPLFKTILESPTDKKVGWKVIFNNMVNQNWGPYDRDSWNPVYGNQLFMKTRNGSMKAADNFLDPNKASSLLSSGFSPDFATVITMDRKASKQQTNIDVIYERVRDDYQLHWTSTNWKGTNTKDKWIDRSSERYKIDWEKEEMTN

SEQ ID NO: 244 - protein, 293 aa, Staphylococcus aureus
ADSDINIKTGTTDIGSNTTVKTGDLVTYDKENGMLKKVFYSFIDDKNHNKKLLVIRTKGTIAGQYRVYSEEGANKSGLAWPSAFKVQLQLPDNEVAQISDLYPRNSIDTKEYMSTLTYGFNGNVTGDDTGKIGGLIGANVSIGHTLKYVQPDFKTILESPTDKKVGWKVIFNNMVNQNWGPYDRDSWNPVYGNQLFMKTRNGSMKAADNFLDPNKASSLLSSGFSPDFATVITMDRKASKQQTNIDVIYERVRDDYQLHWTSTNWKGTNTKDKWIDRSSERYKIDWEKEEMTN

SEQ ID NO: 245 - protein, 293 aa, Staphylococcus aureus
ADSDINIKTGTTDIGSNTTVKTGDLVTYDKENGMLKKVFYSFIDDKNHNKKLLVIRTKGTIAGQYRVYSEEGANKSGLAWPSAFKVQLQLPDNEVAQISDYYPRNSIDTKEYMSTLTYGFNGNVTGDDTGKIGGLIGANVSIGHTLKYVQPLFKTILESPTDKKVGWKVIFNNMVNQNWGPYDRDSWNPVYGNQLFMKTRNGSMKAADNFLDPNKASSLLSSGFSPDFATVITMDRKASKQQTNIDVIYERVRDDYQLHWTSTNWKGTNTKDKWIDRSSERYKIDWEKEEMTN

SEQ ID NO: 246 - protein, 285 aa, Staphylococcus aureus
CGNQGEKNNKAETKSYKMDDGKTVDIPKDPKRIAVVAPTYAGGLKKLGANIVAVNQQVDQSKVLKDKFKGVTKIGDGDVEKVAKEKPDLIIVYSTDKDIKKYQKVAPTVVVDYNKHKYLEQQEMLGKIVGKEDKVKAWKKDWEETTAKDGKEIKKAIGQDATVSLFDEFDKKLYTYGDNWGRGGEVLYQAFGLKMQPEQQKLTAKAGWAEVKQEEIEKYAGDYIVSTSEGKPTPGYESTNMWKNLKATKEGHIVKVDAGTYWYNDPYTLDFMRKDLKEKLIKAAK

SEQ ID NO: 247 - protein, 233 aa, Staphylococcus aureus
GCGIGKEAEVKKSFEKTLSMYPIKNLEDLYDKEGYRDDQFDKNDKGTWIINSEMVIQPNNEDMVAKGMVLYMNRNTKTTNGYYYVDVTKDEDEGKPHDNEKRYPVKMVDNKIIPTKEIKDEKIKKEIENFKFFVQYGDFKNLKNYKDGDISYNPEVPSYSAKYQLTNDDYNVKQLRKRYDIPTSKAPKLLLKGSGNLKGSSVGYKDIEFTFVEKKEENIYFSDSLDYKKSGDV

SEQ ID NO: 248 - protein, 288 aa, Staphylococcus aureus
MASCGNQGEKNNKAETKSYKMDDGKTVDIPKDPKRIAVVAPTYAGGLKKLGANIVAVNQQVDQSKVLKDKFKGVTKIGDGDVEKVAKEKPDLIIVYSTDKDIKKYQKVAPTVVVDYNKHKYLEQQEMLGKIVGKEDKVKAWKKDWEETTAKDGKEIKKAIGQDATVSLFDEFDKKLYTYGDNWGRGGEVLYQAFGLKMQPEQQKLTAKAGWAEVKQEEIEKYAGDYIVSTSEGKPTPGYESTNMWKNLKATKEGHIVKVDAGTYWYNDPYTLDFMRKDLKEKLIKAAK

SEQ ID NO: 249 - protein, 234 aa, Staphylococcus aureus
MGCGIGKEAEVKKSFEKTLSMYPIKNLEDLYDKEGYRDDQFDKNDKGTWIINSEMVIQPNNEDMVAKGMVLYMNRNTKTTNGYYYVDVTKDEDEGKPHDNEKRYPVKMVDNKIIPTKEIKDEKIKKEIENFKFFVQYGDFKNLKNYKDGDISYNPEVPSYSAKYQLTNDDYNVKQLRKRYDIPTSKAPKLLLKGSGNLKGSSVGYKDIEFTFVEKKEENIYFSDSLDYKKSGDV

SEQ ID NO: 250 - protein, 206 aa, Staphylococcus aureus
MAMIKMSPEEIRAKSQSYGQGSDQIRQILSDLTRAQGEIAANWEGQAFSRFEEQFQQLSPKVEKFAQLLEEIKQQLNSTADAVQEQDQQLSNNFGLQASGGGSGGYKGIKADGGKVDQAKQLAAKTAKDIEACQKQTQQLAEYIEGSDWEGQFANKVKDVLLIMAKFQEELVQPMADHQKAIDNLSQNLAKYDTLSIKQGLDRVNP

The invention claimed is:

1. A composition comprising an adjuvant and a polypeptide comprising an amino acid sequence selected from
   (i) a sequence having at least 85% identity to SEQ ID NO: 216 and
   (ii) a fragment of SEQ ID NO: 216, wherein the fragment of SEQ ID NO: 216 comprises (A) at least 20 consecutive amino acids of SEQ ID NO: 216, and (B) at least 20 consecutive amino acids of 114-258 of SEQ ID NO: 216, wherein the amino acid sequence lacks at least 10 amino acids corresponding to amino acids 136-174 of SEQ ID NO: 14.

2. The composition of claim 1, wherein the polypeptide comprises an amino acid sequence selected from (i) a sequence having at least 90% identity to SEQ ID NO: 216.

3. The composition of claim 1, wherein the polypeptide comprises an amino acid sequence selected from (i) a sequence having at least 95% identity to SEQ ID NO: 216; and (ii) a fragment of SEQ ID NO: 216, wherein the fragment of SEQ ID NO: 216 comprises (A) at least 30 consecutive amino acids of SEQ ID NO: 216, and (B) at least 30 consecutive amino acids of 114-258 of SEQ ID NO: 216.

4. The composition of claim 1 or 2, further comprising one or more additional antigens, said one or more antigens selected from the group consisting of:
   (1) a sta006 antigen; (2) a sta011 antigen; (3) a esxA antigen; (4) a esxB antigen; (5) a sta081 antigen; (6) a ebpS antigen; (7) a efb antigen; (8) a emp antigen; (9) a esaC antigen; (10) a coA antigen; (11) a eap antigen; (12) a FnBA antigen; (13) a FnBB antigen; (14) a ebhA antigen; (15) a hlgB antigen; (16) a hlgC antigen; (17) a isdA antigen; (18) a isdB antigen; (19) a isdC antigen; (20) a isdG antigen; (21) a isdH antigen; (22) a isdI antigen; (23) a lukD antigen; (24) a lukE antigen; (25) a lukF antigen; (26) a lukS antigen; (27) a nuc antigen; (28) a sasA antigen; (29) a sasB antigen; (30) a sasC antigen; (31) a sasD antigen; (32) a sasF antigen; (33) a sdrC antigen; (34) a sdrD antigen; (35) a sdrE2 antigen;

(36) a spa antigen; (37) a clfA antigen; (38) a clfB antigen; (39) a sta001 antigen; (40) a sta002 antigen; (41) a sta003 antigen; (42) a sta004 antigen; (43) a sta005 antigen; (44) a sta007 antigen; (45) a sta008 antigen; (46) a sta009 antigen; (47) a sta010 antigen; (48) a sta012 antigen; (49) a sta013 antigen; (50) a sta014 antigen; (51) a sta015 antigen; (52) a sta016 antigen; (53) a sta017 antigen; (54) a sta018 antigen; (55) a sta019 antigen; (56) a sta020 antigen; (57) a sta021 antigen; (58) a sta022 antigen; (59) a sta023 antigen; (60) a sta024 antigen; (61) a sta025 antigen; (62) a sta026 antigen; (63) a sta027 antigen; (64) a sta028 antigen; (65) a sta029 antigen; (66) a sta030 antigen; (67) a sta031 antigen; (68) a sta032 antigen; (69) a sta033 antigen; (70) a sta034 antigen; (71) a sta035 antigen; (72) a sta036 antigen; (73) a sta037 antigen; (74) a sta038 antigen; (75) a sta039 antigen; (76) a sta040 antigen; (77) a sta041 antigen; (78) a sta042 antigen; (79) a sta043 antigen; (80) a sta044 antigen; (81) a sta045 antigen; (82) a sta046 antigen; (83) a sta047 antigen; (84) a sta048 antigen; (85) a sta049 antigen; (86) a sta050 antigen; (87) a sta051 antigen; (88) a sta052 antigen; (89) a sta053 antigen; (90) a sta054 antigen; (91) a sta055 antigen; (92) a sta056 antigen; (93) a sta057 antigen; (94) a sta058 antigen; (95) a sta059 antigen; (96) a sta060 antigen; (97) a sta061 antigen; (98) a sta062 antigen; (99) a sta063 antigen; (100) a sta064 antigen; (101) a sta065 antigen; (102) a sta066 antigen; (103) a sta067 antigen; (104) a sta068 antigen; (105) a sta069 antigen; (106) a sta070 antigen; (107) a sta071 antigen; (108) a sta072 antigen; (109) a sta073 antigen; (110) a sta074 antigen; (111) a sta075 antigen; (112) a sta076 antigen; (113) a sta077 antigen; (114) a sta078 antigen; (115) a sta079 antigen; (116) a sta080 antigen; (117) a sta082 antigen; (118) a sta083 antigen; (119) a sta084 antigen; (120) a sta085 antigen; (121) a sta086 antigen; (122) a sta087 antigen; (123) a sta088 antigen; (124) a sta089 antigen; (125) a sta090 antigen; (126) a sta091 antigen; (127) a sta092 antigen; (128) a sta093 antigen; (129) a sta094 antigen; (130) a sta095 antigen; (131) a sta096 antigen; (132) a sta097 antigen; (133) a sta098 antigen; (134) a sta099 antigen; (135) a sta100 antigen; (136) a sta101 antigen; (137) a sta102 antigen; (138) a sta103 antigen; (139) a sta104 antigen; (140) a sta105 antigen; (141) a sta106 antigen; (142) a sta107 antigen; (143) a sta108 antigen; (144) a sta109 antigen; (145) a sta110 antigen; (146) a sta111 antigen; (147) a sta112 antigen; (148) a sta113 antigen; (149) a sta114 antigen; (150) a sta115 antigen; (151) a sta116 antigen; (152) a sta117 antigen; (153) a sta118 antigen; (154) a sta119 antigen; (155) a sta120 antigen; (156) a NW__6 antigen; (157) a NW__9 antigen; (158) a NW__10 antigen; (159) a NW__7 antigen; (160) a NW__8 antigen; (161) a NW__2 antigen; (162) a NW__1 antigen; and (163) a NW__5 antigen.

5. The composition of claim 1 or 2, wherein the composition includes an aluminium hydroxide adjuvant, and optionally wherein the composition includes a histidine buffer.

6. The composition of claim 1 or 2, further comprising: one or more conjugates of (i) a *S. aureus* expolysaccharide and (ii) a carrier protein.

7. The composition of claim 1 or 2, further comprising: one or more conjugates of (i) a *S. aureus* capsular polysaccharide and (ii) a carrier protein.

8. A method for raising an immune response in a mammal comprising the step of administering to the mammal an effective amount of a composition comprising a polypeptide comprising an amino acid sequence selected from
(i) a sequence having at least 85% identity to SEQ ID NO: 216 and
(ii) a fragment of SEQ ID NO: 216, wherein the fragment of SEQ ID NO: 216 comprises (A) at least 20 consecutive amino acids of SEQ ID NO: 216, and (B) at least 20 consecutive amino acids of 114-258 of SEQ ID NO: 216, wherein the amino acid sequence lacks at least 10 amino acids corresponding to amino acids 136-174 of SEQ ID NO: 14.

9. The method of claim 8, wherein the polypeptide comprises an amino acid sequence selected from (i) a sequence having at least 90% identity to SEQ ID NO: 216.

10. The method of claim 8, wherein the polypeptide comprises an amino acid sequence selected from (i) a sequence having at least 95% identity to SEQ ID NO: 216; and (ii) a fragment of SEQ ID NO: 216, wherein the fragment of SEQ ID NO: 216 comprises (A) at least 30 consecutive amino acids of SEQ ID NO: 216, and (B) at least 30 consecutive amino acids of 114-258 of SEQ ID NO: 216.

11. The method of any one of claims 8, 9, or 10, wherein the composition further comprises an adjuvant.

* * * * *